US009631215B2

(12) United States Patent
Houghton-Larsen et al.

(10) Patent No.: US 9,631,215 B2
(45) Date of Patent: Apr. 25, 2017

(54) RECOMBINANT PRODUCTION OF STEVIOL GLYCOSIDES

(75) Inventors: Jens Houghton-Larsen, Birkeroed (DK); Paula Hicks, Bend, OR (US); Michael Naesby, Basel (CH); Thomas Tange Ostergaard, Basel (CH); Jorgen Hansen, Frederiksberg (DK); Michael Mikkelsen Dalgaard, Væløse (DK); Esben Hansen Halkjaer, Frederiksberg (DK); Ernesto Simon, Copenhagen (DK); Sabina De Andrade Periera Tavares, Basel (CH)

(73) Assignee: EVOLVA SA, Reinach (CH)

( * ) Notice: Subject to any disclaimer, the term of this patent is extended or adjusted under 35 U.S.C. 154(b) by 0 days.

(21) Appl. No.: 14/237,540

(22) PCT Filed: Aug. 8, 2012

(86) PCT No.: PCT/US2012/050021

§ 371 (c)(1), (2), (4) Date: May 15, 2014

(87) PCT Pub. No.: WO2013/022989

PCT Pub. Date: Feb. 14, 2013

(65) Prior Publication Data

US 2014/0329281 A1 Nov. 6, 2014

Related U.S. Application Data

(60) Provisional application No. 61/521,084, filed on Aug. 8, 2011, provisional application No. 61/521,203, filed on Aug. 8, 2011, provisional application No. 61/521,051, filed on Aug. 8, 2011, provisional application No. 61/523,487, filed on Aug. 15, 2011, provisional application No. 61/567,929, filed on Dec. 7, 2011, provisional application No. 61/603,639, filed on Feb. 27, 2012.

(51) Int. Cl.

| | |
|---|---|
| ***C12P 19/56*** | (2006.01) |
| ***C12N 9/02*** | (2006.01) |
| ***C12N 9/10*** | (2006.01) |
| ***C12N 9/90*** | (2006.01) |
| ***C12N 1/15*** | (2006.01) |
| ***C12N 1/21*** | (2006.01) |
| ***C12N 9/88*** | (2006.01) |
| ***C12N 9/06*** | (2006.01) |
| ***C12N 15/81*** | (2006.01) |
| ***C12N 15/82*** | (2006.01) |
| ***C12P 19/44*** | (2006.01) |
| ***C12N 15/63*** | (2006.01) |

(52) U.S. Cl.

CPC ............ *C12P 19/56* (2013.01); *C12N 9/0032* (2013.01); *C12N 9/0071* (2013.01); *C12N 9/0073* (2013.01); *C12N 9/1051* (2013.01); *C12N 9/1085* (2013.01); *C12N 9/88* (2013.01); *C12N 9/90* (2013.01); *C12N 15/63* (2013.01); *C12N 15/81* (2013.01); *C12N 15/8243* (2013.01); *C12P 19/44* (2013.01); *Y02P 20/52* (2015.11)

(58) Field of Classification Search

None

See application file for complete search history.

(56) References Cited

U.S. PATENT DOCUMENTS

| | | | |
|---|---|---|---|
| 4,590,160 | A | 5/1986 | Nishihashi et al. |
| 5,204,253 | A | 4/1993 | Sanford et al. |
| 5,306,862 | A | 4/1994 | Chappell et al. |
| 5,460,949 | A | 10/1995 | Saunders et al. |
| 5,538,880 | A | 7/1996 | Lundquist et al. |
| 6,013,863 | A | 1/2000 | Lundquist et al. |
| 6,215,051 | B1 | 4/2001 | Yu et al. |
| 6,255,557 | B1 | 7/2001 | Brandle |
| 6,284,493 | B1 | 9/2001 | Roth |
| 6,284,506 | B1 | 9/2001 | Hoshino et al. |
| 6,329,571 | B1 | 12/2001 | Hiei |
| 6,586,202 | B2 | 7/2003 | Hoshino et al. |
| 6,660,507 | B2 | 12/2003 | Cheng et al. |
| 6,806,076 | B1 | 10/2004 | Miyake et al. |
| 6,969,595 | B2 | 11/2005 | Brzostowicz et al. |
| 7,034,140 | B2 | 4/2006 | Bramucci et al. |
| 7,056,717 | B2 | 6/2006 | Cheng et al. |

(Continued)

FOREIGN PATENT DOCUMENTS

| | | |
|---|---|---|
| CN | 101720910 | 6/2010 |
| CN | 103397064 | 11/2013 |

(Continued)

OTHER PUBLICATIONS

Nakagiri et al., cDNA cloning, functional expression and characterization of ent-copalyl diphosphate synthase from *Scoparia dulcis* L., Plant Sci., 2005, 169, 760-67.*

(Continued)

*Primary Examiner* — Robert Mondesi

*Assistant Examiner* — Todd M Epstein

(74) *Attorney, Agent, or Firm* — McDonnell Boehnen Hulbert & Berghoff LLP

(57) ABSTRACT

Recombinant microorganisms, plants, and plant cells are disclosed that have been engineered to express recombinant genes encoding UDP-glycosyltransferases (UGTs). Such microorganisms, plants, or plant cells can produce steviol glycosides, e.g., Rebaudioside A and/or Rebaudioside D, which can be used as natural sweeteners in food products and dietary supplements.

34 Claims, 47 Drawing Sheets

(56) References Cited

U.S. PATENT DOCUMENTS

| | | | | |
|---|---|---|---|---|
| 7,098,000 | B2 | 8/2006 | Cheng et al. | |
| 7,129,392 | B2 | 10/2006 | Hahn et al. | |
| 7,132,268 | B2 | 11/2006 | Miyake et al. | |
| 7,172,886 | B2 | 2/2007 | Keasling et al. | |
| 7,183,089 | B2 | 2/2007 | Keasling et al. | |
| 7,186,891 | B1 | 3/2007 | Chappell et al. | |
| 7,208,298 | B2 | 4/2007 | Miyake et al. | |
| 7,335,815 | B2 | 2/2008 | Boronate et al. | |
| 7,364,885 | B2 | 4/2008 | Miyake et al. | |
| 7,422,884 | B2 | 9/2008 | Bai et al. | |
| 7,569,389 | B2 | 8/2009 | Feldmann et al. | |
| 7,838,287 | B2 | 11/2010 | Goldsmith et al. | |
| 7,923,541 | B2 | 4/2011 | Yang et al. | |
| 7,927,851 | B2 | 4/2011 | Brandle et al. | |
| 2002/0142408 | A1 | 10/2002 | DiCosimo et al. | |
| 2003/0033626 | A1 | 2/2003 | Hahn et al. | |
| 2003/0148416 | A1 | 8/2003 | Berry et al. | |
| 2003/0148479 | A1 | 8/2003 | Keasling et al. | |
| 2003/0190734 | A1 | 10/2003 | Hoshino et al. | |
| 2003/0219798 | A1 | 11/2003 | Gokarn et al. | |
| 2004/0010815 | A1 | 1/2004 | Lange et al. | |
| 2004/0072311 | A1 | 4/2004 | DiCosimo et al. | |
| 2004/0078846 | A1 | 4/2004 | DeSouza et al. | |
| 2004/0176570 | A1 | 9/2004 | Bacher et al. | |
| 2004/0194162 | A1 | 9/2004 | Hahn et al. | |
| 2005/0003474 | A1 | 1/2005 | DeSouza et al. | |
| 2005/0032169 | A1 | 2/2005 | Miyake et al. | |
| 2006/0014264 | A1 | 1/2006 | Sauer et al. | |
| 2006/0079476 | A1 | 4/2006 | Keasling et al. | |
| 2006/0083838 | A1 | 4/2006 | Jackson et al. | |
| 2007/0004000 | A1 | 1/2007 | Miyake et al. | |
| 2007/0077616 | A1 | 4/2007 | Keasling et al. | |
| 2007/0099261 | A1 | 5/2007 | Keasling et al. | |
| 2007/0128311 | A1 | 6/2007 | Prakash et al. | |
| 2007/0166782 | A1 | 7/2007 | Keasling et al. | |
| 2007/0202579 | A1 | 8/2007 | Berry et al. | |
| 2007/0238157 | A1 | 10/2007 | Millis et al. | |
| 2007/0238159 | A1 | 10/2007 | Millis et al. | |
| 2007/0238160 | A1 | 10/2007 | Millis et al. | |
| 2007/0254354 | A1 | 11/2007 | Millis et al. | |
| 2007/0269857 | A1 | 11/2007 | Miyake et al. | |
| 2007/0286850 | A1 | 12/2007 | Bai et al. | |
| 2008/0064063 | A1 | 3/2008 | Brandle et al. | |
| 2008/0081358 | A1 | 4/2008 | Viitanen et al. | |
| 2008/0131926 | A1 | 6/2008 | Miyake et al. | |
| 2008/0261280 | A1 | 10/2008 | Hahn et al. | |
| 2008/0271205 | A1 | 10/2008 | Yamaguchi et al. | |
| 2008/0286870 | A1 | 11/2008 | Viitanen et al. | |
| 2008/0292775 | A1 | 11/2008 | Prakash et al. | |
| 2008/0318227 | A1 | 12/2008 | Bacher et al. | |
| 2009/0004724 | A1 | 1/2009 | Keasling et al. | |
| 2009/0047718 | A1 | 2/2009 | Blaschek et al. | |
| 2009/0074935 | A1 | 3/2009 | Lee | |
| 2009/0286262 | A1 | 11/2009 | Slack | |
| 2010/0112156 | A1 | 5/2010 | Abelyan et al. | |
| 2010/0297722 | A1 | 11/2010 | Anterola et al. | |
| 2011/0087011 | A1 | 4/2011 | Chiang et al. | |
| 2011/0160311 | A1 | 6/2011 | Prakash et al. | |
| 2012/0021111 | A1 | 1/2012 | Pfister et al. | |
| 2012/0164678 | A1* | 6/2012 | Stephanopoulos ...... | A01H 5/00 435/29 |
| 2012/0178169 | A1 | 7/2012 | Voytas et al. | |
| 2013/0137138 | A1 | 5/2013 | Hansen | |
| 2015/0159188 | A1 | 6/2015 | Ono et al. | |

FOREIGN PATENT DOCUMENTS

| | | |
|---|---|---|
| EP | 0955363 | 11/1999 |
| EP | 1072683 | 1/2001 |
| EP | 1171610 | 4/2007 |
| EP | 1198575 | 9/2007 |
| EP | 1383864 | 1/2008 |
| EP | 1897951 | 3/2008 |
| EP | 1947189 | 7/2008 |
| EP | 1392824 | 8/2008 |
| JP | 3277275 | 12/1991 |
| JP | 05-115298 | 5/1993 |
| WO | 99/18224 | 4/1999 |
| WO | 00/36081 | 6/2000 |
| WO | 00/37663 | 6/2000 |
| WO | 00/63400 | 10/2000 |
| WO | 01/12828 | 2/2001 |
| WO | 01/83769 | 11/2001 |
| WO | 01/94561 | 12/2001 |
| WO | 02/20728 | 3/2002 |
| WO | 02/20815 | 3/2002 |
| WO | 02/055709 | 7/2002 |
| WO | 03/008540 | 1/2003 |
| WO | 2004/029255 | 4/2004 |
| WO | 2005/079183 | 9/2005 |
| WO | WO 2006/016395 | 2/2006 |
| WO | 2006/093289 | 9/2006 |
| WO | 2006/096392 | 9/2006 |
| WO | 2007/136847 | 11/2007 |
| WO | 2008/008256 | 1/2008 |
| WO | 2008/034648 | 3/2008 |
| WO | 2008/039499 | 4/2008 |
| WO | 2008/051349 | 5/2008 |
| WO | 2009/005704 | 1/2009 |
| WO | 2009/071277 | 6/2009 |
| WO | 2009/086049 | 7/2009 |
| WO | WO 2009/105612 | 8/2009 |
| WO | 2009/108680 | 9/2009 |
| WO | 2009/140394 | 11/2009 |
| WO | 2010/021001 | 2/2010 |
| WO | 2010/038911 | 4/2010 |
| WO | 2010/146463 | 12/2010 |
| WO | 2011/028671 | 3/2011 |
| WO | 2011/037959 | 3/2011 |
| WO | 2011/046423 | 4/2011 |
| WO | 2011/056834 | 5/2011 |
| WO | 2011/153378 | 8/2011 |
| WO | 2011/151326 | 12/2011 |
| WO | 2011/153144 | 12/2011 |
| WO | 2012/075030 | 6/2012 |
| WO | 2013/019050 | 2/2013 |
| WO | 2013/096420 | 6/2013 |
| WO | 2013/102793 | 7/2013 |
| WO | 2013/110673 | 8/2013 |
| WO | 2013/176738 | 11/2013 |
| WO | 2014/086890 | 6/2014 |
| WO | 2014/122227 | 8/2014 |
| WO | 2014/122328 | 8/2014 |

OTHER PUBLICATIONS

Uniprot, Accession No. F2DG34, May 2011, www.uniprot.org.*

Uniprot, Accession No. Q6VAA8, 2004, www.uniprot.org.*

Uniprot, Accession No. Q7FPQ4, 2004, www.uniprot.org.*

Senthilraja et al., RNA secondary structure prediction: analysis of *Saccharomyces cerevisiae* RNAs, Int. J. Pharm. Sci. Rev. Res., 2014, 25, 287-91.*

Abraham & Bhat, "Permeabilization of baker's yeast with N-lauroyl sarcosine," J Ind Microbial Biotechnol. 35 (8):799-804 (2008).

Chen et al., "Transferring a biosynthetic cycle into a productive *Escherichia coli* strain: large-scale synthesis of galactosides," J Am Chem Soc. 123(36):8866-7 (2001).

Chow & Palecek, "Enzyme encapsulation in permeabilized *Saccharomyces cerevisiae* cells," Biotechnol Prog. 20 (2):449-56 (2004).

Flores et al., "Permeabilization of yeast cells (*Kluyveromyces lactis*) with organic solvents," Enzyme Microb Technol. 16(4):340-6 (1994).

Freire, "Differential scanning calorimetry," Methods Mol Biol. 40:191-218 (1995).

Gietz & Schiestl, "High-efficiency yeast transformation using the LiAc/SS carrier DNA/PEG method," Nat Protoc. 2 (1):31-4 (2007).

Gossen & Bujard, "Studying gene function in eukaryotes by conditional gene inactivation," Ann Rev Genet. 36:153-73 (2002).

Kondo et al., "Preparation of high activity whole cell biocatalyst by permeabilization of recombinant flocculent yeast with alcohol," Enzyme Microb Technol. 27(10),806-11 (2000).

(56) References Cited

OTHER PUBLICATIONS

Li et al., "Crystal structure of Medicago truncatula UGT85H2—insights into the structural basis of a multifunctional (iso) flavonoid glycosyltransferase," J Mol Biol. 370(5):951-63 (2007).
Liu et al., "Preparation of high-activity whole cell biocatalysts by permeabilization of recombinant yeasts with alcohol," J Biosci Bioeng. 89(6):554-8 (2000).
Naglak & Wang, "Rapid protein release from *Escherichia coli* by chemical permeabilization under fermentation conditions," Biotechnol Bioeng. 39(7):732-40 (1991).
Newman et al., "High-level production of amorpha-4,11-diene in a two-phase partitioning bioreactor of metabolically engineered *Escherichia coli*," Biotechnol Bioeng 95(4):684-91 (2006).
Paradise et al., "Redirection of flux through the FPP branch-point in *Saccharomyces cerevisiae* by down-regulating squalene synthase," Biotechnol Bioeng. 100(2):371-8 (2008).
Presecki & Vasic-Racki, "Production of L-malic acid by permeabilized cells of commercial *Saccharomyces* sp. strains," Biotechnol Lett. 27(23-24)1835-9 (2005).
Ro et al., "Production of the antimalarial drug precursor artemisinic acid in engineered yeast," Nature 440(7086):940-3 (2006).
Yu et al., "Bioconversion of ethyl 4-chloro-3-oxobutanoate by permeabilized fresh brewer's yeast cells in the presence of allyl bromide," J Ind Microbiol Biotechnol. 34(2)151-6 (2007).
Ajikumar et al., "Terpenoids: opportunities for biosynthsis of natural product drugs using engineered microorganisms," Molecular Pharmaceuticals 5(2):167-90 (2008).
Alakomi et al., "Lactic acid permeabilizes gram-negative bacteria by disrupting the outer membrane," Appl Environ Microbiol. 66(5):2001-5 (2000).
Ali et al., "Biochemical investigation during different stages of in vitro Ppropagation of Stevia rebaudiana," Pak J Bot. 42(4):2827-37 (2010).
Bateman et al., "PFAM 3.1: 1313 multiple alignments and profile HMMs match the majority of proteins," Nucl Acids Res. 27(1):260-2 (1999).
Brandle et al., "Leaf ESTs from Stevia rebaudiana: A Resource for Gene Discovery in Diterpene Synthesis," Plant Mol Biol. 50(4-5):613-22 (2002).
Brandle & Telmer, "Steviol glycoside biosynthesis," Phytochemistry 68(14):1855-63 (2007).
Brochado et al. "Improved vanillin production in baker's yeast through in silico design," Microb Cell Fact. 9:84-98 (2010).
Carretero-Paulet et al., "Expression and Molecular Analysis of the Arabidopsis DXR Gene Encoding 1-Deoxy-d-Xylulose 5-Phosphate Reductoisomerase, the First Committed Enzyme of the 2-C-Methyl-D-Erythritol 4-Phosphate Pathway," Plant Physiol. 129(4):1581-91 (2002).
Chemler et al., "Biosynthesis of isoprenoids, polyunsaturated fatty acids and flavonoids in *Saccharomyces cerevisiae*," Microb Cell Fact. 5:20 (2006).
Chenna et al., "Multiple sequence alignment with the Clustal series of programs," Nucleic Acids Res. 31 (13):3497-500 (2003).
Correa et al., "Genetic mapping of 1,3-beta-glucanase-encoding genes in *Saccharomyces cerevisiae*," Current Genet. 22(4):283-8 (1992).
Dubey, et al., "An overview of the non-mevalonate pathway for terpenoid biosynthesis in plants," J. Biosci. 28 (5):637-46 (2003).
Fernandez et al., "Activation of chitin synthetase in permeabilized cells of a *Saccharomyces cerevisiae* mutant lacking proteinase B," J Bacteriol. 152(3):1255-64 (1982).
Fowler & Zabin, "Effects of Dimethylsulfoxide on the Lactose Operon in *Escherichia coli*," J Bacteriol. 92(2):353-7 (1966).
Gunel et al., "Metabolic Engineering for Production of Geranylgeranyl Pyrophosphate Synthase in NonCarotenogenic Yeast *Schizosaccharomyces Pombe*," Biotechnol. & Biotechnol. Eq. 20(3):76-82 (2006).
Hansen et al., "De novo biosynthesis of vanillin in fission yeast (*Schizosaccharomyces pombe*) and baker's yeast (*Saccharomyces cerevisiae*)," Appl Environ Microbiol. 75(9):2765-74 (2009).
Hansen et al., "Versatile Enzyme Expression and Characterization System for Aspergillus nidulans, with the Penicillium brevicompactum Polyketide Synthase Gene from the Mycophenolic Acid Gene Cluster as a Test Case," Appl Environ Microbiol. 77(9):3044-51 (2011).
Humphrey et al., "Spatial organisation of four enzymes from Stevia rebaudiana that are involved in steviol glycoside synthesis," Plant Mol Bio. 61(1-2):47-62 (2006).
Iandolino et al., "High-Quality RNA, cDNA, and Derived EST Libraries From Grapevine (*Vitis vinifera* L.)," Plant Mol Biol Reporter 22:269-78 (2004).
Jennewein et al., "Taxol biosythesis: baxane 13 alpha-hydroxylase is a cytochrome P450-dependent monooxygenase," Proc Natl Acad Sci U S A 98(24):13595-600 (2001).
Jewett et al. "An integrated cell-free metabolic platform for protein production and synthetic biology," Mol Syst Biol. 4:220 (2008).
Johnstone et al., "Cloning an Aspergillus nidulans developmental gene by transformation," EMBO J. 4(5):1307-11 (1985).
Kim & Shibata, "Characterization of ent-kaurenoic acid 13-hydroxylase in steviol biosynthesis of Stevia rebaudiana Bertoni," Journal of the Korean Agriculturalchemical Society 40(6):501-7 (1997).
Knowles et al., "Genetic Transformation and Plant Regeneration in Stevia rebaudiana Using Microprojectile Bombardment," In Vitro Cellular & Developmental Biology 39(abstract):23-A (2003).
Li et al., "Phylogenetic analysis of the UDP-glycosyltransferase multigene family of Arabidopsis thaliana," J Biol Chem. 276(6):4338-43 (2001).
Li et al., "Systematic Mutational Analysis of Peptide Inhibition of the p53-MDM2/MDMX," J Mol Biol. 398(2):200-13 (2010).
Ma et al., "Molecular cloning and characterization of Stevia Rebaudiana UDP-glucosyltransferase," Acta Biologiae Experimentalis Sinica 36(2):123-9 (2003).
Madan et al., "Stevia rebaudiana (Bert.) Bertoni—A Review," Indian Journal of Natural Products and Resources 1 (3):267-86 (2010).
Malonek et al., "The NADPH-cytochrome P450 Reductase Gene from Gibberalla fujikuroi is Essential for Gibberellin Biosynthesis," J Bio Chem. 279(24):25075-84 (2004).
Mantovaneli et al., "The effect of temperature and flow rate on the clarification of the aqueous stevia-extract in a fixed-bed column with zeolites," Braz J Chem Eng. 21(3):449-58 (2004).
Masada et al., "An efficient chemoenzymatic production of small molecule glucosides with in situ UDP-glucose recycling," FEBS Lett. 581(13):2562-6 (2007).
Megeji et al., "Introducing Stevia rebaudiana, a natural zero-calorie sweetener," Current Science 88(5):801-4 (2005).
Mumberg et al., "Yeast vectors for the controlled expression of heterologous proteins in different genetic backgrounds," Gene 156(1):119-22 (1995).
Naesby et al., "Yeast artificial chromosomes employed for random assembly of biosynthetic pathways and production of diverse compounds in *Saccharomyces cerevisiae*," Microb Cell Fact. 8:45 (2009).
Nielsen et al., "Efficient PCR-based gene targeting with a recyclable marker for Aspergillus nidulans," Fungal Genet Biol. 43(1):54-64 (2006).
Ohtani et al., "Further Study on the 1,4-alpha-Transglucosylation of Rubusoside, a Sweet Steviol-Bisglucoside from Rubus suavissimus," Agric Biol Chem. 55(2):449-53 (1991).
Oka & Jigami, "Reconstruction of de novo pathway for synthesis of UDP-glucuronic acid and UDP-xylose from intrinsic UDP-glucose in *Saccharomyces cerevisiae*," FEBS J. 273(12):2645-57 (2006).
Osmani et al., "Catalytic key amino acids and UDP-sugar donor specificity of a plant glucuronosyltransferase, UGT94B1: molecular modeling substantiated by site-specific mutagenesis and biochemical analyses," Plant Phys. 148 (3):1295-1308 (2008).
Pearson & Lipman, "Improved tools for biological sequence comparison," Proc Natl Acad Sci. 85(8):2444-8 (1998).
Riesmeier et al., "Isolation and characterization of a sucrose carrier cDNA from spinach by functional expression in yeast," EMBO J 11(13):4705-13 (1992).

(56) References Cited

OTHER PUBLICATIONS

Rodriguez-Concepcion & Boronat, "Elucidation of the methylerythritol phosphate pathway for isoprenoid biosynthesis in bacteria and plastids. A metabolic milestone achieved through genomics," Plant Physiol. 130 (3):1079-89 (2002).
Sauer et al., "The soluble and membrane-bound transhydrogenases UdhA and PntAB have divergent functions in NADPH metabolism of *Escherichia coli*," J Biol Chem. 279(8):6613-9 (2004).
Sawada et al., "UDP-glucuronic acid:anthocyanin glucuronosyltransferase from red daisy (*Bellis perennis*) flowers. Enzymology and phylogenetics of a novel glucuronosyltransferase involved in flower pigment biosynthesis," J Biol Chem. 280(2):899-906 (2005).
Shao et al., "Enhanced production of alpha-galactosyl epitopes by metabolically engineered Pichia pastoris," Appl Environ Microbiol. 69(9):5238-42 (2003).
Shao et al., "Crystal structures of a multifunctional triterpene/flavonoid glycosyltransferase from Medicago truncatula," Plant Cell 17(11):3141-54 (2005).
Singh et al., "Compendium of Transgenic Crop Plants: Transgenic Sugar, Tuber and Fiber," Ed. Kole & Hall, Blackwell Publishing Ltd. pp. 97-115 (2008).
Son et al., "Production of flavonoid o-glucoside using sucrose synthase and flavonoid o-glucosyltransferase fusion protein," J Microbiol Biotechnol. 19(7):709-12 (2009).
Sonnhammer et al., "Pfam: multiple sequence alignments and HMM-profiles of protein domains," Nucleic Acids Res. 26(1):320-2 (1998).
Sonnhammer et al., "Pfam: a comprehensive database of protein domain families based on seed alignments," Proteins 28(3):405-420 (1997).
Vazquez De Aldana et al., "Nucleotide sequence of the exo-1,3-beta-glucanase-encoding gene, EXG1, of the yeast *Saccharomyces cerevisiae*," Gene 97(2):173-82 (1991).
First Examination Report issued by the Intellectual Property Office of New Zealand for New Zealand Application No. 604915, dated Sep. 2, 2013 (2 pages).
Response to First Examination Report issued by the Intellectual Property Office of New Zealand for New Zealand Application No. 604915, dated Jan. 17, 2014 (24 pages).
Further Examination Report issued by the Intellectual Property Office of New Zealand for New Zealand Application No. 604915, dated Feb. 3, 2014 (2 pages).
Response to Further Examination Report issued by the Intellectual Property Office of New Zealand for New Zealand Application No. 604915, dated May 27, 2014 (42 pages).
Further Examination Report issued by the Intellectual Property Office of New Zealand for New Zealand Application No. 604915, dated Jun. 18, 2014 (4 pages).
Response to Further Examination Report issued by the Intellectual Property Office of New Zealand for New Zealand Application No. 604915, dated Sep. 15, 2014 (16 pages).
Search Report issued by the Intellectual Property Office of Singapore for Singaporean Application No. 201208854-8, dated Nov. 3, 2014 (8 pages).
Written Opinion issued by the Intellectual Property Office of Singapore for Singaporean Application No. 201208854-8, dated Nov. 3, 2014 (13 pages).
Agrawal, "NMR spectroscopy in the structural elucidation of oligosaccharides and glycosides," Phytochemistry 31 (10):3307-30 (1992).
Bo, "1. Molecular Cloning and Function Analysis of UDPG Glucosyltransferase Gene 2. Molecular Cloning, Sequence Analysis and Evolution of Actin and EF1α Genes in Stevia Rebaudiana," Chinese Doctor and Master Dissertations Full-Text Database, Agricultural Technology Part, vol. 2 (2004).
Chica et al., "Semi-rational approaches to engineering enzyme activity: combining the benefits of directed evolution and rational design," Curr Opin Biotechnol. 16(4):378-84 (2005).
Eisenreich et al., "Biosynthesis of isoprenoids via the non-mevalonate pathway," Cell Mol Life Sci. 61(12):1401-6 (2004).
Geuns, "Stevioside," Phytochemistry 64(5):913-21 (2003).
Goralczyk, "Compounds from Stevia for Improving and Maintaining Mental Performance," Stevia World Forum (2010) (17 pages).
Imler et al., "Indole alkaloid biosynthesis in Catharanthus roseus: new enzyme activities and identification of cytochrome P450 CYP72A1 as secologanin synthase," Plant J. 24(6):797-804 (2000).
Kim et al., "Hydroxylation of ent-Kaurenoic Acid to Steviol in Stevia rebaudiana Bertoni—Purification and Partial Characterization of the Enzyme," Arch Biochem Biophys. 332(2):223-30 (1996).
Kohda et al., "New Sweet Diterpene glucoside from Stevia Rebaudiana," Phytochemistry 15(6):981-3 (1976).
Morita et al., "Japanese morning glory dusky mutants displaying reddish-brown or purplish-gray flowers are deficient in a novel glycosylation enzyme for anthocyanin biosynthesis, UDP-glucose:anthocyanidin 3-O-glucoside-2"-O-glucosyltransferase, due to 4-bp insertions in the gene," Plant J. 42(3):353-63 (2005).
Nelson et al., "P450 superfamily: update on new sequences, gene mapping, accession numbers and nomenclature," Pharmacogenetics 6:1-42 (1996).
Osmani et al., "Substrate specificity of plant UDP-dependent glycosyltransferases predicted from crystal structures and homology modeling," Phytochemistry 70(3):325-47 (2009).
Pompon et al., "Yeast Expression of Animal and Plant P450s in Optimized Redox Environments," Methods Enzymol 272:51-64 (1996).
Richman et al., "Functional genomics uncovers three glucosyltransferases involved in the synthesis of the major sweet glucosides of Stevia rebaudiana," Plant J. 41(1):56-67 (2005).
Schwab et al., Poster, "Watchmaker®—Compound Generation by Combinatorial Genetics and Screening in Yeast," SBS 14th Annual Conference (2008) (1 page).
Sen et al., "Developments in Directed Evolution for Improving Enzyme Functions," Appl Biochem Biotechnol. 143 (3):212-23 (2007).
Yadav et al., "A review on the improvement of stevia [*Stevia rebaudiana* (Bertoni)]," Can J Plant Sci. 91:1-27 (2011).
First Office Action issued by the State Intellectual Property Office of People's Republic of China for CN Application No. 201180038475.4, dated Nov. 21, 2013. Translation Provided (16 pages).
Response to First Office Action issued by the State Intellectual Property Office of People's Republic of China for CN Application No. 201180038475.4, dated Apr. 8, 2014. Translation Provided (17 pages).
Response to Second Office Action issued by the State Intellectual Property Office of People's Republic of China for CN Application No. 201180038475.4, dated Oct. 28, 2014. Translation Provided (30 pages).
Verwaal et al., "High-Level Production of Beta-Carotene in *Saccharomyces cerevisiae* by Successive Transformation with Carotenogenic Genes from Xanthophyllomyces dendrorhous," Appl Environ Microbiol. 73 (13):4342-50 (2007).
Wallin, "Steviol Glycosides," Chem. Tech Assessment—63rd JECFA (2004).
Wallin, "Steviol Glycosides," Chem. Tech Assessment—69th JECFA (2007).
Wang, "Structure, mechanism and engineering of plant natural product glycosyltransferases," FEBS Letters 583 (20):3303-9 (2009).
Yao et al., "A genetic linkage map for Stevia rebaudiana," Genome 42:657-61 (1999).
International Search Report issued by the International Searching Authority for International Application No. PCT/US2012/050021, dated Apr. 12, 2013 (8 pages).
Written Opinion of the International Searching Authority for International Application No. PCT/US2012/050021, dated Apr. 12, 2013 (10 pages).
International Preliminary Report on Patentability issued by the International Bureau for International Application No. PCT/US2012/050021, dated Feb. 11, 2014 (11 pages).

(56) References Cited

OTHER PUBLICATIONS

First Office Action and Search Report issued by the State Intellectual Property Office of People's Republic of China for Chinese Application No. 201280038853.3, dated Feb. 16, 2015. Translation Provided (10 pages).
Communication pursuant to Rules 161(1) and 162 (EPC) issued by the European Patent Office for European Application No. 12750513.9, dated Mar. 14, 2014 (2 pages).
Response to Communication pursuant to Rules 161(1) and 162 (EPC) issued by the European Patent Office for European Application No. 12750513.9, dated Aug. 4, 2014 (3 pages).
Examination Report issued by the European Patent Office for European Application No. 12750513.9, dated Nov. 26, 2014 (4 pages).
Response to Examination Report issued by the European Patent Office for European Application No. 12750513.9, dated Mar. 25, 2014 (3 pages).
International Search Report issued by the International Searching Authority for International Application No. PCT/US2011/038967, dated Sep. 1, 2011 (10 pages).
Written Opinion of the International Searching Authority for International Application No. PCT/US2011/038967, dated Sep. 1, 2011 (12 pages).
International Preliminary Report on Patentability issued by the International Bureau for International Application No. PCT/US2011/038967, dated Dec. 4, 2012 (13 pages).
Third-Party Submission under 37 CFR 1.290 for U.S. Appl. No. 13/701,406, dated Mar. 22, 2013 (238 pages).
Patent Examination Report No. 1 issued by IP Australia for Australian Application No. 2011261394, dated Jan. 15, 2015 (4 pages).
Response to Patent Examination Report No. 1 issued by IP Australia for Australian Application No. 2011261394, dated Feb. 5, 2015 (55 pages).
Patent Examination Report No. 2 issued by IP Australia for Australian Application No. 2011261394, dated Feb. 23, 2015 (3 pages).
Second Office Action issued by the State Intellectual Property Office of People's Republic of China for Chinese Application No. 201180038475.4, dated Aug. 13, 2014. Translation Provided (5 pages).
Third Office Action issued by the State Intellectual Property Office of People's Republic of China for Chinese Application No. 201180038475.4, dated Mar. 3, 2015. Translation Provided (7 pages).
Extended European Search Report and Opinion issued by the European Patent Office for European Application No. 11790428.4, dated Dec. 20, 2013 (7 pages).
Response to Extended Search Report and Opinion issued by the European Patent Office for European Application No. 11790428.4, dated Jul. 16, 2014 (4 pages).
Communication pursuant to Rule 114(2) EPC for European Application No. 11790428.4, dated Nov. 28, 2014 (22 pages).
Examination Report issued by the European Patent Office for European Application No. 11790428.4, dated Dec. 1, 2014 (3 pages).
Examination Report issued by the Intellectual Property Corporation of Malaysia for Malaysian Application No. PI 2012005201, dated Jul. 31, 2014 (4 pages).
Response to Examination Report issued by the Intellectual Property Corporation of Malaysian for MY Application No. PI 2012005201, dated Sep. 18, 2014 (4 pages).
GenBank Accession No. DQ3988713, dated May 28, 2008 (2 pages).
GenBank Accession No. EDY51667, dated Sep. 2, 2008 (2 pages).
GenBank Accession No. EU263989, dated Jun. 11, 2008 (2 pages).
GenBank Accession No. EU722415.1, dated Jun. 10, 2008 (2 pages).
GenBank Accession No. EU751291.1, dated Jun. 24, 2008 (2 pages).
GenBank Accession No. NM_116512, dated Jan. 22, 2014 (3 pages).
GenBank Accession No. NP_001105097, dated Aug. 4, 2015 (2 pages).
GenBank Accession No. NP_013636.1 (YML075C), dated Jul. 16, 2015 (3 pages).
GenBank Accession No. NP_194183, dated Jan. 22, 2014 (4 pages).
GenBank Accession No. NP_195399, dated Jan. 22, 2014 (3 pages).
GenBank Accession No. NP_197872.1, dated Jan. 22, 2014 (2 pages).
GenBank Accession No. Q9UVY5.1, dated Apr. 1, 2015 (3 pages).
GenBank Accession No. XM_001467423, dated Jul. 16, 2015 (2 pages).
GenBank Accession No. XP_002282091, dated Dec. 7, 2011 (1 page).
GenBank Accession No. XP_002288339, dated Jul. 15, 2009 (2 pages).
GenBank Accession No. XP_002311286, dated Dec. 31, 2013 (2 pages).
GenBank Accession No. ZP_05004570, dated Jun. 8, 2010 (2 pages).
EBI Accession No. AAY05902, "Jerusalem artichoke in-chain hydroxylase CYP81B1," dated Jun. 15, 2007 (1 page).
EBI Accession No. ABM86477, "Rice abiotic stress responsive polypeptide Seq ID No:4723," dated Jun. 2, 2005 (1 page).
Notice of Acceptance issued by IP Australia for Australian Application No. 2011261394, dated Aug. 13, 2015 (pp. 1-3).
Notification of Grant of Patent Application issued by the State Intellectual Property Office of People's Republic of China for Chinese Application No. 201180038475.4, dated Dec. 1, 2015 (pp. 1-5). English translation included.
Response to Examination Report issued by the European Patent Office for European Application No. 11790428.4, dated Jun. 1, 2015 (16 pages).
English Translation of Notification of Reasons for Refusal of Japanese Application No. 2013-513355, dated Aug. 4, 2015 (pp. 1-10).
Notice of Acceptance issued by the Intellectual Property Office of New Zealand for New Zealand Application No. 604915, dated Oct. 7, 2014 (1 page).
First Examination Report issued by the Intellectual Property Office of New Zealand for New Zealand Application No. 700097, dated Oct. 6, 2014 (pp. 1-2).
Notice of Acceptance issued by the Intellectual Property Office of New Zealand for New Zealand Application No. 700097, dated Oct. 7, 2015 (1 page).
First Examination Report issued by the Intellectual Property Office of New Zealand for New Zealand Application No. 708078, dated May 28, 2015 (pp. 1-3).
English Translation of Second Office Action and Search Report issued by the State Intellectual Property Office of People's Republic of China for Chinese Application No. 201280038853.3, dated Jan. 11, 2016.
International Search Report from the International Searching Authority for International Application No. PCT/EP2014/052363, mailed Sep. 22, 2014 (12 pages).
Written Opinion of the International Searching Authority for International Application No. PCT/EP2014/052363, mailed Sep. 22, 2014 (10 pages).
International Preliminary Report on Patentability issued by the International Bureau for International Application No. PCT/EP2014/052363, dated Aug. 11, 2015. (11 pages).
Communication pursuant to Rules 161(1) and 162 EPC for European Application No. 14702889.8, dated Oct. 14, 2015 (2 pages).
International Search Report by the International Searching Authority for International Application No. PCT/EP2014/052675, mailed Apr. 23, 2014 (5 pages).
Written Opinion of the International Searching Authority for International Application No. PCT/EP2014/052675, mailed Apr. 23, 2014 (7 pages).
International Preliminary Report on Patentability issued by the International Bureau for International Application No. PCT/EP2014/052675, dated Aug. 11, 2015. (8 pages).

(56) References Cited

OTHER PUBLICATIONS

Communication pursuant to Rules 161(1) and 162 EPC for European Application No. 14704558.7, dated Sep. 18, 2015 (2 pages).
Response to Communication pursuant to Rules 161(1) and 162 EPC for European Application No. 14704558.7, dated Mar. 17, 2016 (pp. 1-24).
International Search Report of the International Searching Authority for International Application No. PCT/EP2013/075587, mailed Feb. 20, 2014 (pp. 1-5).
Written Opinion of the International Searching Authority for International Application No. PCT/EP2013/075587, mailed Feb. 20, 2014 (pp. 1-9).
International Preliminary Report on Patentability from the International Bureau for International Application No. PCT/EP2013/075587, dated Jun. 9, 2015 (pp. 1-10).
Communication pursuant to Rules 161(1) and 162 EPC for European Application No. 13801569.8, dated Jul. 14, 2015 (2 pages).
Response to Communication pursuant to Rules 161(1) and 162 EPC for European Application No. 13801569.8, Jan. 13, 2016 (9 pages).
International Search Report of the International Searching Authority for International Application No. PCT/EP2015/068314, dated Jan. 20, 2016 (pp. 1-7).
Written Opinion of the International Searching Authority for International Application No. PCT/EP2015/068314, dated Jan. 20, 2016 (pp. 1-9).
Ageitos et al., "Oily yeasts as oleaginous cell factories," Appl Microbiol Biotechnol. 90(4):1219-27 (May 2011).
Bankar et al., "Environmental and industrial applications of Yarrowia lipolytica," Appl Microbiol Biotechnol. 84 (5):847-65 (Oct. 2009).
Bay & Turner, "Diversity and evolution of the small multidrug resistance protein family," BMC Evol. Biol. 9:140 (Jun. 2009).
Baykov et al., "A malachite green procedure for orthophosphate determination and its use in alkaline phosphatase-based enzyme immunoassay," Anal Biochem. 171(2):266-70 (Jun. 1988).
Beopoulos et al., "Yarrowia lipolytica: A model and a tool to understand the mechanisms implicated in lipid accumulation," Biochimie 91(6):692-6 (Jun. 2009).
Brachmann et al., "Designer deletion strains derived from *Saccharomyces cerevisiae* S288C: a useful set of strains and plasmids for PCR-mediated gene disruption and other applications," Yeast 14:115-32 (1998).
Ceunen & Geuns, "Steviol glycosides: chemical diversity, metabolism, and function," J. Nat. Prod. 76(6):1201-28 (Jun. 2013).
Chen et al., "MolProbity: all-atom structure validation for macromolecular crystallography," Acta Crystallogr D Biol Crystallogr 66(Pt 1):12-21 (Jan. 2010).
Darise et al., "Enzymic Transglucosylation of Rubusoside and the Structure-Sweetness Relationship of Steviol-Bisglycosides," Agric. Biol. Chem. 48(10):2483-8 (Jan. 1984).
Davis et al., "MolProbity: all-atom contacts and structure validation for proteins and nucleic acids," Nucleic Acids Res. 35:W375-83 (Apr. 2007).
Del Sorbo et al., "Fungal transporters involved in efflux of natural toxic compounds and fungicides," Fungal. Genet. Biol. 30(1):1-15 (Jun. 2000).
Diener et al., "Arabidopsis ALF5, a multidrug efflux transporter gene family member, confers resistance to toxins," Plant Cell 13(7):1625-38 (Jul. 2001).
Dodhia et al., "Engineering human cytochrome P450 enzymes into catalytically self-sufficient chimeras using molecular Lego," J Biol Inorg Chem. 11(7):903-16 (Oct. 2006).
Dubois & Stephenson, "Diterpenoid sweeteners. Synthesis and sensory evaluation of stevioside analogues with improved organoleptic properties," J. Med. Chem. 28(1):93-8 (Jan. 1985).
EFSA Panel on Food Additives and Nutrient Sources added to Food (ANS), "Scientific Opinion on the safety of steviol glycosides for the proposed uses as a food additive," EFSA Journal 8(4):1537 (2010).
Emmerstorfer et al., "Over-expression of ICE2 stabilizes cytochrome P450 reductase in *Saccharomyces cerevisiae* and Pichia pastoris," Biotechnol J. 10(4):623-35 (Apr. 2015).
Estrada De Martin et al., "Ice2p is important for the distribution and structure of the cortical ER network in *Saccharomyces cerevisiae*," J Cell Sci. 118(Pt 1):65-77 (Oct. 2006).
Fukunaga et al., "Enzymatic transglucosylation products of stevioside: separation and sweetness-evaluation," Agric. Biol. Chem. 53(6):1603-7 (Jan. 1989).
Giaever & Nislow, "The yeast deletion collection: a decade of functional genomics," Genetics 197(2):451-65 (Jun. 2014).
Girvan et al., "Flavocytochrome P450 BM3 mutant W1046A is a NADH-dependent fatty acid hydroxylase: implications for the mechanism of electron transfer in the P450 BM3 dimer," Arch Biochem Biophys. 507(1):75-85 (Mar. 2011).
Gritz & Davies, "Plasmid-encoded hygromycin B resistance: the sequence of hygromycin B phosphotransferase gene and its expression in *Escherichia coli* and *Saccharomyces cerevisiae*," Gene 25(2-3):179-88 (Nov. 1983).
Guleria & Yadav, "Insights into Steviol Glycoside Biosynthesis Pathway Enzymes Through Structural Homology Modeling," Am. J. Biochem. Molec. Biol. 3(1):1-19 (2013).
Hallstrom & Moye-Rowley, "Divergent transcriptional control of multidrug resistance genes in *Saccharomyces cerevisiae*," J. Biol. Chem. 273(4):2098-104 (Jan. 1998).
Hellfritsch et al., "Human psychometric and taste receptor responses to steviol glycosides," J. Agric. Food Chem. 60(27):6782-93 (Jul. 2012).
Katzmann et al., "Expression of an ATP-binding cassette transporter-encoding gene (YOR1) is required for oligomycin resistance in *Saccharomyces cerevisiae*," Mol. Cell Biol. 15(12):6875-83 (Dec. 1995).
Khoury et al., "Computational design of Candida boidinii xylose reductase for altered cofactor specificity," Protein Sci. 18(10):2125-38 (Oct. 2009).
Kusama et al., "Transglucosylation into stevioside by the enzyme system from *Streptomyces* sp.," Agric. Biol. Chem. 50(10):2445-51 (Oct. 1986).
Li et al., "High-density cultivation of oleaginous yeast *Rhodosporidium toruloides* Y4 in fed-batch culture," Enzyme and Microbial Technology 41(3):312-7 (Aug. 2007).
Madhav et al., "Functional and structural variation of uridine diphosphate glycosyltransferase (UGT) gene of Stevia rebaudiana—UGTSr involved in the synthesis of rebaudioside A," Plant Physiol. Biochern. 63:245-53 (Feb. 2013).
Mattanovich et al., "Recombinant protein production in yeasts," Methods Mol Biol. 824:329-58 (2012).
Nagy et al., "Role of the yeast ABC transporter Yor1p in cadmium detoxification," Biochimie 88(11):1665-71 (Jun. 2006).
Nicaud, "Yarrowia lipolytica," Yeast 29(10):409-18 (Oct. 2012).
Nikaido & Takatsuk, "Mechanisms of RND multidrug of pumps," Biochim. Biophys. Acta. 1794(5):769-81 (May 2009).
Nour-Eldin et al., "User cloning and User fusion: the ideal cloning techniques for small and big laboratories," Methods Mol Biol. 643:185-200 (2010).
Ohta et al., "Characterization of Novel Steviol Glycosides from Leaves of Stevia rebaudiana Morita," J. Applied Glycosides 57(3):199-209 (Mar. 2010).
Ohta et al., MassBank Accession No. FU000341 (May 2011).
Ohta et al., MassBank Accession No. FU000342 (May 2011).
Ohta et al., MassBank Accession No. FU000343 (May 2011).
Orihara et al., "Biotransformation of steviol by cultured cells of eucalyptus perriniana and Coffea Arabica," Phytochemistry 30(12):3989-92 (1991).
Piirainen et al., "Glycoengineering of yeasts from the perspective of glycosylation efficiency," N Biotechnol. 31 (6):532-7 (Dec. 2014).
Prelich, "Gene overexpression: uses, mechanisms, and interpretation," Genetics 190(3):841-54 (Mar. 2012).
Saenge et al., "Potential use of oleaginous red yeast *Rhodotorula glutinis* for the bioconversion of crude glycerol from biodiesel plant to lipids and carotenoids," Process Biochemistry 46(1):210-8 (Jan. 2011).

(56) References Cited

OTHER PUBLICATIONS

Saier JR et al., "The major facilitator superfamily," J. Mol. Microbiol. Biotechnol. 1(2):257-79 (Nov. 1999).
Saier et al., "The Transporter Classification Database: recent advances," Nucleic Acids Res. 37:D274-8 (Jan. 2009).
U.S. Food and Drug Administration GRAS Notice 323, "Gras Assessment of High Purity Steviol Glycosides; Food Usage Conditions for General Recognition of Safety for PureCircle USA, Inc.," pp. 1-262 (Feb. 2010).
U.S Food and Drug Administration GRAS Notice Notice 329, "Notice to the U.S. Food and Drug Administration that the use of RebpureTM (Rebaudioside A) derived from Stevia rebaudiana, as a Food Ingredient is Generally Recognized as Safe (GRAS)," pp. 1-275 (Mar. 2010).
Van Ooyen et al., "Heterologous protein production in the yeast *Kluyveromyces lactis*," FEMS Yeast Res. 6 (3):381-92 (May 2006).
Wallner & Elofsson, "Can correct protein models be identified?," Protein Sci. 12(5):1073-86 (May 2003).
Xu et al., "Generation of hepatitis B virus PreS2-S antigen in Hansenula polymorpha," Virol Sin. 29(6):403-9 (Dec. 2014).
Yazaki, "ABC transporters involved in the transport of plant secondary metabolites," FEBS Lett. 580(4):1183-91 (Feb. 2006).
Yuan et al., "Kinetics and activation parameters for oxidations of styrene by Compounds I from the cytochrome P450 (IBM-3) (CYP102A1) heme domain and from CYP119," Biochemistry 48(38):9140-6 (Sep. 2009).
Zheng et al. "An efficient one-step site-directed and site-saturation mutagenesis protocol," Nucleic Acids Res. 32(14): e115 (Aug. 2004).
Zhu et al., "A multi-omic map of the lipid-producing yeast *Rhodosporidium toruloides*," Nature Commun. 3:1112 (Oct. 2012).
GenBank Accession No. AAB62280, dated Jul. 2, 1997 (2 pages).
GenBank Accession No. AAB87091, dated Mar. 22, 2000 (2 pages).
GenBank Accession No. AAC28895.1, dated Aug. 6, 1998 (2 pages).
GenBank Accession No. AAC39505, dated Jul. 26, 1998 (1 page).
GenBank Accession No. AAD34294, dated Mar. 22, 2000 (2 pages).
GenBank Accession No. AAD34295, dated Mar. 22, 2000 (2 pages).
GenBank Accession No. AAD47596, dated Aug. 9, 1999 (2 pages).
GenBank Accession No. AAF61439.1, dated Sep. 25, 2000 (2 pages).
GenBank Accession No. AAH69913, dated Jul. 15, 2006 (2 pages).
GenBank Accession No. AAM53963.1, dated Jun. 17, 2002 (2 pages).
GenBank Accession No. AAR06912, dated Dec. 28, 2004 (2 pages).
GenBank Accession No. AAR06916.1, dated Dec. 28, 2004 (2 pages).
GenBank Accession No. AAR06918.1, dated Dec. 28, 2004 (2 pages).
GenBank Accession No. AAR06920.1, dated Dec. 28, 2004 (2 pages).
GenBank Accession No. AAT93110.1, dated Apr. 24, 2007 (2 pages).
GenBank Accession No. ABA42921, dated Jun. 21, 2006 (1 page).
GenBank Accession No. ABB88839, dated May 28, 2008 (2 pages).
GenBank Accession No. ABC59076, dated Jun. 6, 2007 (1 page).
GenBank Accession No. ABC98596, dated Jan. 31, 2014 (2 pages).
GenBank Accession No. ABD60225, dated May 28, 2008 (2 pages).
GenBank Accession No. ABD92926, dated Oct. 10, 2007 (2 pages).
GenBank Accession No. AC133334, dated Jan. 31, 2004 (44 pages).
GenBank Accession No. ACD93722, dated Jun. 10, 2008 (1 page).
GenBank Accession No. ACE87855.1, dated Jun. 24, 2008 (1 page).
GenBank Accession No. ACM47734.1, dated Feb. 7, 2009 (1 page).
GenBank Accession No. ACT33422.1, dated Jul. 17, 2009 (1 page).
GenBank Accession No. AEE36246, dated Oct. 6, 2014 (3 pages).
GenBank Accession No. AF034774, dated Apr. 17, 1998 (2 pages).
GenBank Accession No. AF515727.1, dated Jun. 17, 2002 (2 pages).
GenBank Accession No. AY345974.1, dated Dec. 28, 2004 (2 pages).
GenBank Accession No. AY345978.1, dated Dec. 28, 2004 (2 pages).
Genbank Accession No. AY345980.1, dated Dec. 28, 2004 (2 pages).
GenBank Accession No. AY345982.1, dated Dec. 28, 2004 (2 pages).
GenBank Accession No. AY562490, dated May 23, 2006 (3 pages).
GenBank Accession No. BAA43200, dated Mar. 13, 1999 (2 pages).
GenBank Accession No. BAB59027, dated Jan. 30, 2002 (1 page).
GenBank Accession No. BAF61135, dated May 9, 2007 (2 pages).
GenBank Accession No. BAG30962, dated Nov. 12, 2012 (2 pages).
GenBank Accession No. BC153262, dated Oct. 4, 2007 (3 pages).
GenBank Accession No. BG521726.1, dated May 13, 2000 (2 pages).
GenBank Accession No. CAA23011.1, dated Oct. 23, 2008 (2 pages).
GenBank Accession No. CAA46815.1, dated Apr. 18, 2005 (2 pages).
GenBank Accession No. CAA75568, dated Nov. 14, 2006 (2 pages).
GenBank Accession No. CAA76703, dated Nov. 14, 2006 (1 page).
GenBank Accession No. CAE09055, dated Nov. 14, 2006 (2 pages).
GenBank Accession No. CAG41604, dated Feb. 6, 2015 (2 pages).
GenBank Accession No. DQ269454.4, dated May 28, 2008 (2 pages).
Office Action for Canadian Patent Application No. 2,802,627, mailed Dec. 15, 2015 (pp. 1-5).
International Search Report and Written Opinion of the International Searching Authority for International Application No. PCT/EP2015/052007; mailed Jul. 4, 2016, pp. 1-24.
EMBOSS Needle results for Pairwise Sequence Alignment of UGT91D1 and UGT91D2; dated Apr. 4, 2016, 2 pages.
Shibata et al., "Glucosylation of Steviol and Steviol-Glucosides in Extracts from Stevia rebaudiana Bertoni" Plant Physiol. 95(1):152-56 (1991).
Communication pursuant to Rule 114(2) EPC for European Application No. 11790428.4, dated Apr. 25, 2016 (19 pages).
Examination Report issued by the European Patent Office for European Application No. 11790428.4, dated May 13, 2016 (12 pages).
Decision of Refusal in Japanese Patent Application No. 2013-513355; dispatch No. 304859, dispatch date Jul. 6, 2016, pp. 1-3. English translation submitted.
Second Written Opinion in Singapore Patent Application No. 201208854-8; dated Apr. 18, 2016, pp. 1-12.
Extended European Search Report issued in EP 15193074.0; dated Feb. 12, 2016, pp. 1-9.
Communication pursuant to Article 94(3) EPC in European Application No. 14 702 889.8; dated Jul. 27, 2016, pp. 1-5.
Third Party Submission in U.S. Appl. No. 14/648,747; dated Mar. 28, 2016, pp. 1-231.
Invitation to Pay Additional Fees and, Where Applicable, Protest Fee by the International Searching Authority for International Application No. PCT/EP2015/070620, mailed Nov. 27, 2015, pp. 1-14.
International Search Report by the International Searching Authority for International Application No. PCT/EP2015/070620; mailed Mar. 29, 2016, pp. 1-10.
Written Opinion of the International Searching Authority for International Application No. PCT/EP2015/070620; mailed Mar. 29, 2016, pp. 1-24.
Kumar et al., "A comprehensive analysis of fifteen genes of steviol glycosides biosynthesis pathwayin *Stevia rebaudiana* (Bertoni)" Gene 492:276-84 (Epub Oct. 20, 2011).
Mohamed et al., "UDP-dependent glycosyltransferases involved in the biosynthesis of steviol glycosides" Journal of Plant Physiology 168(10):1136-1141 (Jul. 2011; Epub Apr. 7, 2011).

* cited by examiner

Steviol
Steviolmonoside
Steviolbioside
Stevioside
Rebaudioside A
Rebaudioside B
Rebaudioside C
Rebaudioside D
Rebaudioside E
Rebaudioside F
Dulcoside A

FIGURE 6

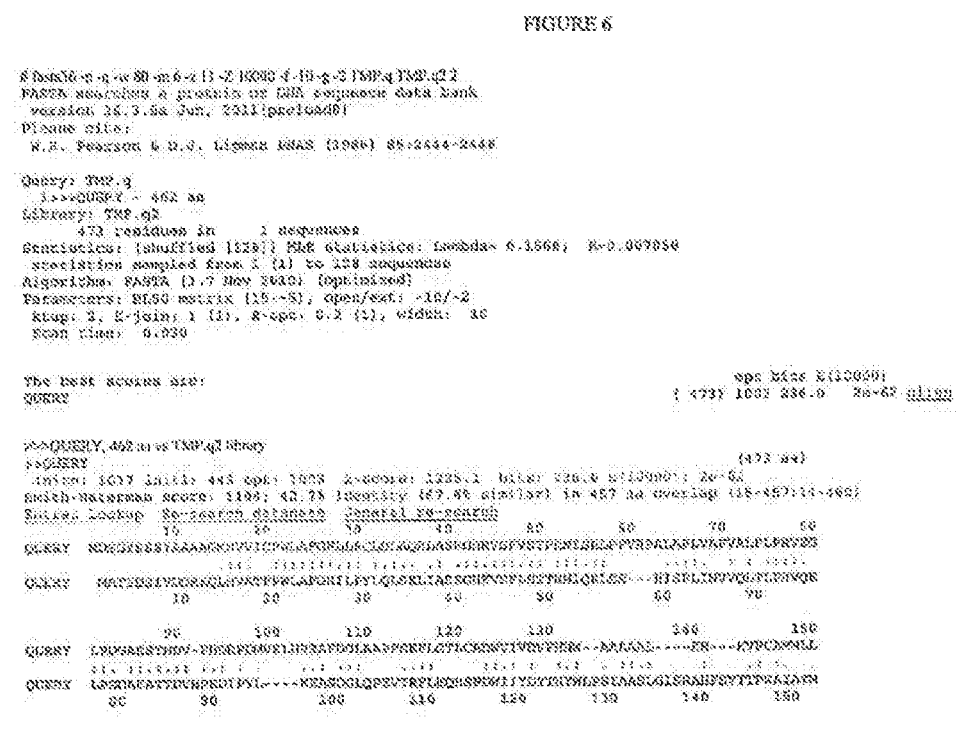

```
[illegible]
FASTA searches a protein or DNA sequence data bank
 version 36.3.5a Jun, 2011(preload9)
Please cite:
 W.R. Pearson & D.J. Lipman PNAS (1988) 85:2444-2448

Query: TNF.q
  1>>>QUERY - 462 aa
Library: TNF.q2
      473 residues in     1 sequences
Statistics: (shuffled [128]) MLE statistics: Lambda= 0.1568;  K=0.007050
 statistics sampled from 1 (1) to 128 sequences
Algorithm: FASTA (3.7 Nov 2010) (optimized)
Parameters: BL50 matrix (15:-5), open/ext: -10/-2
 ktup: 2, E-join: 1 (1), E-opt: 0.2 (1), width:  16
 Scan time:  0.030

The best scores are:                                  opt bits E(10000)
QUERY                                       ( 473) 1001 236.0   2e-67 align

>>QUERY, 462 aa vs TNF.q2 library
>>QUERY                                                        (473 aa)
 initn: 1017 init1: 443 opt: 1001  Z-score: 1235.1  bits: 236.0 E(10000): 2e-67
Smith-Waterman score: 1190; 42.7% identity (67.4% similar) in 457 aa overlap (18-457:14-462)
Links: Lookup  Re-search database  General re-search
[illegible]
QUERY  [illegible]
       [illegible]
QUERY  [illegible]
[illegible]

[illegible]
QUERY  [illegible]
       [illegible]
QUERY  [illegible]
[illegible]
```

FIGURE 6 (cont'd)

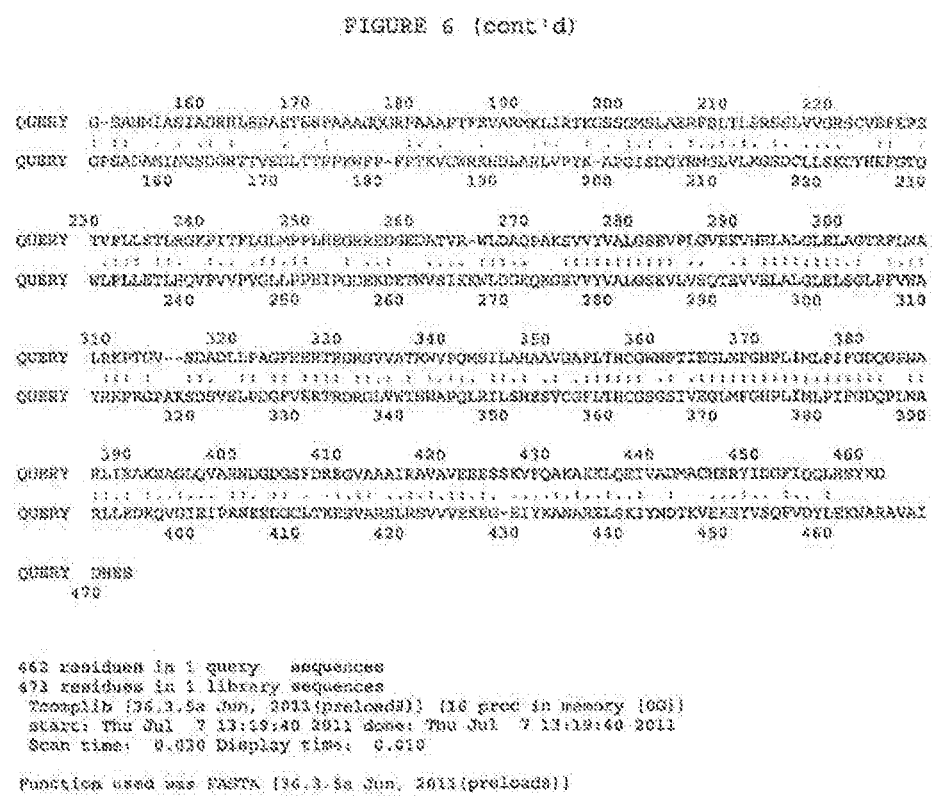

```
                 160       170       180       190       200       210       220
QUERY  G-SAUMIASIADRRLSDASTSSPAAAGKGRPAAAFTFRVAGMKLIATKGSSGMSLARRFSLTLSRSGLVVGRSCVDEFPS

QUERY  GFSAGASINGSDGRTTVEGLTTPPKWPP-FPTKVGNNKHGLAALVPTK-APGISDGYNMSLVLKGRDCLLSKCYHEPSTG
           160       170       180       190       200       210       220       230

    230       240       250       260       270       280       290       300
QUERY  TVPLLSTLRGKPITFLGLMPPLRSGKKEDGSEDATVR-WLDAQPAKSVVTVALGSEVPLGVESVHELALGLELAGTRFLWA

QUERY  WLPLLETLRQVPVVPVGLLPPEIPGGEKDETNVSIKEWLDGKQHGSVVYVALGSKVLVSQTEVVELALGLELSGLPFVWA
           240       250       260       270       280       290       300       310

    310       320       330       340       350       360       370       380
QUERY  LRKPTGV--SDADLLPAGFEERTRGRGVVATRWVPQMSILAHAAVGAPLTHCGWNSTIEGLMFGHPLIMLPIFGDQGPNA

QUERY  YRKPRGPAKSDSVELPDGFVERTRDRGLVWTSWAPQLRILSHESVCGFLTHCGSGSIVEGLMFGHPLIMLPIFGDQPLNA
           320       330       340       350       360       370       380       390

      390       400       410       420       430       440       450       460
QUERY  RLIEAKNAGLQVARNDGDGSFDREGVAAAIRAVAVEEESSKVFQAKAKKLQEIVADMACHERYIDGFIQQLRSYKD

QUERY  RLLEDKQVGIRIPRNEEDGCLTKESVARSLRSVVVEKEG-EIYKANARELSKIYNDTKVEEKYVSQFVDYLEKNARAVAI
           400       410       420       430       440       450       460       470

QUERY  DHES
     470
```

463 residues in 1 query sequences
473 residues in 1 library sequences
Tcomplib [36.3.5a Jun, 2013(preload8)] (16 proc in memory [0G])
start: Thu Jul 7 13:19:40 2011 done: Thu Jul 7 13:19:40 2011
Scan time: 0.030 Display time: 0.010

Function used was FASTA [36.3.5a Jun, 2013(preload8)]

Figure 7

>EUGT-11 Protein. (SEQ ID NO: 152)

>EUGT-11 Native gene. (SEQ ID NO: 153)

>EUGT-11 Optimized DNA. (SEQ ID NO: 154)

FIGURE 9

```
                                 loopN1                      loopN2
UGT91D1   MATSDSIVDD RKQLHVATFP WLAFGHILPF LQLSKLIAEK GHKVSFLSTT RNIQRLSSHI 60
UGT91D2e  MATSDSIVDD RKQLHVATFP WLAFGHILPY LQLSKLIAEK GHKVSFLSTT RNIQRLSSHI 60

                                    loopN3/Nα3
UGT91D1   SPLINVVQLT LPRVQELPED AEATTDVHPE DIQYLKKAVD GLQPEVTRFL EQHSPDWIIY 120
UGT91D2e  SPLINVVQLT LPRVQELPED AEATTDVHPE DIPYLKKASD GLQPEVTRFL EQHSPDWIIY 120

          loopN4                 loopN5   Nα5
UGT91D1   DETHYWLPSI AASLGISRAY FCVITPWTIA YLAPSSDAMI NGSDGRTTVE DLTTPPKWFP 180
UGT91D2e  DYTHYWLPSI AASLGISRAH FSVTTPWAIA YMGPSADAMI NGSDGRTTVE DLTTPPKWFP 180

                Nα5a                 Nα5b
UGT91D1   FPTKVCWRKH DLARMEPYEA PGISDGYRMG MVFKGSDCLL FKCYHEFGTQ WLPLLETLHQ 240
UGT91D2e  FPTKVCWRKH DLARLVPYKA PGISDGYRMG LVLKGSDCLL SKCYHEFGTQ WLPLLETLHQ 240

                                                  loopC1
UGT91D1   VPVVPVGLLP PEIPGDEKDE TWVSIKKWLD GKQKGSVVYV ALGSEALVSQ TEVVELALGL 300
UGT91D2e  VPVVPVGLLP PEIPGDEKDE TWVSIKKWLD GKQKGSVVYV ALGSEVLVSQ TEVVELALGL 300

UGT91D1   ELSGLPFVWA YRKPKGPAKS DSVELPDGFV ERTRDRGLVW TSWAPQLRIL SHESVCGFLT 360
UGT91D2e  ELSGLPFVWA YRKPKGPAKS DSVELPDGFV ERTRDRGLVW TSWAPQLRIL SHESVCGFLT 360

                                 loopC5
UGT91D1   HCGSGSIVEG LMFGHPLIML PIFCDQPLNA RLLEDKQVGI EIPRNEEDGC LTKESVARSL 420
UGT91D2e  HCGSGSIVEG LMFGHPLIML PIFGDQPLNA RLLEDKQVGI EIPRNEEDGC LTKESVARSL 420

UGT91D1   RSVVVENEGE IYKANARALS KIYNDTKVEK EYVSQFVDYL EKNARAVAID HES 474
UGT91D2e  RSVVVEKEGE IYKANARELS KIYNDTKVEK EYVSQFVDYL EKNARAVAID HES 474
```

*Stevia rebaudiana* KAH nucleotide (SEQ ID NO: 163)

ATGGAGGCTTCATATCTATACATTTCCATTCTTCTGCTTCTAGCTTCGTACCTCTTCACCACCCAACTTCGTCGTAAATCCGCCAATCT
ACCGCCGACGGTGTTCCCATCCATCCCCATAATCGGTCATCTCTACCTCCTCAAAAAACCACTCTATAGAACACTAGCCAAAATTGCCG
CGAAATACGGCCCTATCCTCCAACTCCAACTAGGGTACCGCCGTGTCCTCCTAATCTCCTCCCCTTCCGCCGCCGAAGAATGCTTCACC
AACAACGACGTTATCTTCGCCAACCGTCCGAAGACGCTATTCGGAAAAATTGTAGGGGGTACCAGCCTCGGGTCGCTGTCGTACGGCGA
CCAGTGGCGCAACCTCCGCCGCGTTGCATCCATCGAGATCCTATCAGTCCACCGGCTCAACGAGTTTCACGACATACGTCTTGACGAAA
ACCGGCTTCTCATCCGTAAACTAAGATCGAGTTCTTCTCCGGTCACTCTCATAACCGTCTTTTACGCACTAACGTTAAATGTCATTATG
AGAATGATGTCCCGAAAGAGCTATTTCGACTCGGCTCATCCGGAATTCAGCAGCGAAGCGAACCGATTCCCGCAGATACTCCATCACAC
ACTTTTCCTCCGCGGTGCTTCTAATCTTGCCGATTACTTGCCCATTCTCAATTGGTTCGGGTCAAGACCTTCGACAAGAAGCTAATCC
CATTGCAGAAAAAGAGAGATGATTTCTTTCAGGGACTGATCGAGCAAGTTCGGAAATCTAGAGGGGCTAAAGTGGGAAAAGGAAGGAAG
ACGATGATCCACTTGTTGTTATCCCTACAAGAATCTGAACCTGACTATTACACTGACGCCATGATCCCATCATTTGTGCTGGGTTTATT
AGCAGCAGGGACTGATACATCGGCTGGAACTATGGAATGGGCGATGTCTCTTTTGGTAAACCACCCCCACGTATTAAAAAAGGCACAGG
CTGAAATTGATCGAGTCATCGGCAACAACCGTCTAATTGATGAGTCCGACATAGGGAATATACCTTACATTGGTTGCATCATAAACGAG
ACCCTCAGATTGTACCCTGCGGGCCCCGTTGCTATTTCCCCATGAGTCATCAGCGGACTGTGTTATCAGCGGGTACAACATCCCTCGTGG
GACGATGCTTATTGTCAACCAATGGGCGATACATCATGACCCAAAGCTGTGGACGACCCTGAGACATTCAAACCGGAAAGATTCCAAG
GGCTTGAAGGGACACGAGACGGGTTTAAGCTGATGCCTTTTGGGTCCGGAAGGAGGGGTTGTCCAGGGGAGGGATTGGCGATTCGTTTG
CTTGCCGATGACTCTCGGGTCGGTTATCCAATGCTTTGATTGGGAACGAGTCGGTGACGAGATCGTTGATATGACCGAAGGTCTTGGGT
CACGTTGCCTAAAGCTGTACCATTAGTCGCCAAGTGCAAGCCCCGTTCCGAAATGACGAATCTACTCTCTGAGCTATGA

FIG. 12B

*Stevia rebaudiana* KAHe1 nucleotide (SEQ ID NO: 165)

ATGGAAGCCTCTTACCTATACATTTCTATTTTGCTTTTACTGGCATCATACCTGTTCACCACTCAACTTAGAAGGAAGAGCGCTAATCT
AGCAGCAACCGTGTTTCCATCAATACCAATCATTGGACACTTATACTTACTCAAAAAGCCTCTTTATAGAACTTTAGCAAAAATTGCCG
CTAAGTACGGACCAATACTGCAATTACAACTCGGCTACAGACGTGTTCTGGTGATTTCCTCACCATCAGCAGCAGAAGAGTGCTTTACC
AATAACGATGTAATCTTCGCAAATAGACCTAAGACATTGTTTGGCAAAATAGTGGGTGGAACATCCCTTGGCAGTTTATCCTACGGCGA

FIGURE 12B (cont'd)

```
TCAATGGCGTAATCTAAGGAGAGTAGCTTCTATCGAAATCCTATCAGTTCATAGGTTGAACGAATTTCATGATATCAGAGTGGATGAGA
ACAGATTGTTAATTAGAAAACTTAGAAGTTCATCTTCTCCTGTTACTCTTATAACAGTCTTTTATGCTCTAACATTGAACGTCATTATG
AGAATGATCTCTGGCAAAAGATATTTCGACAGTGGGGATAGAGAATTGGACGAGGAAGGTAAGAGATTTCGAGAAATCTTAGACGAAAC
GTTGCTTCTAGCCGGTGCTTCTAATGTTGGCGACTACTTACCAATATTGAACTGGTTGGGAGTTAAGTCTCTTGAAAAGAAATTGATCG
CTTTGCAGAAAAAGAGAGATGACTTTTTCCAGGGTTTGATTGAACAGGTTAGAAAATCTCGTGGTGCTAAAGTAGGCAAAGGTAGAAAA
ACGATGATCGAACTCTTATTATCTTTGCAAGAGTCAGAACCTGAGTACTATACAGATGCTATGATAAGATCTTTTGTCCTAGGTCTGCT
GGCTGCAGGTAGTGATACTTCAGCGGGCACTATGGAATGGGCCATGAGCTTACTGGTCAATCACCCACATGTATTGAAGAAAGCTCAAG
CTGAAATCGATAGAGTTATCGGTAATAACAGATTGATTGACGAGTCAGACATTGGAAATATCCCTTACATCGGGTGTATTATCAATGAA
ACTCTAAGACTCTATCCAGCAGGGCCATTGTTGTTCCCACATGAAAGTTCTGCCGACTGCGTTATTTCCGGTTACAATATACCTAGAGG
TACAATGTTAATCGTAAACCAATGGGCGATTCATCACGATCCTAAAGTCTGGGATGATCCTGAAACCTTTAAACCTGAAAGATTTCAAG
GATTAGAAGGAACTAGAGATGGTTTCAAACTTATGCCATTCGGTTCTGGGAGAAGAGGATGTCCAGGTGAAGGTTTGGCAATAAGGCTG
TTAGGGATGACACTAGGCTCAGTGATCCAATGTTTTGATTGGGAGAGAGTAGGAGATGAGATGGTTGACATGACAGAAGGTTTGGGTGT
CACACTTCCTAAGGCCGTTCCATTAGTTGCCAAATGTAAGCCACGTTCCGAAATGACTAATCTCCTATCCGAACTTCAA
```

FIG. 12C

*Stevia rebaudiana* KAHe1 polypeptide (SEQ ID NO:164)

```
MEASYLYISILLLLASYLFTTQLRRKSANLPPTVFPSIPIIGHLYLLKKPLYRTLAKIAA
KYGPILQLQLGYRRVLVISSPSAAEECFTNNDVIFANRPKTLFGKIVGGTSLGSLSYGDQ
WRNLRRVASIEILSVHRLNEFHDIRVDENRLLIRKLRSSSSPVTLITVFYALTLNVIMRM
ISGKRYFDSGDRELEEEGKRFREILDETLLLAGASNVGDYLPILNWLGVKSLEKKLIALQ
KKRDDFFQGLIEQVRKSRGAKVGKGRKTMIELLLSLQESEPEYYTDAMIRSFVLGLLAAG
SDTSAGTMEWAMSLLVNHPHVLKKAQAEIDRVIGNNRLIDESDIGNIPYIGCIINETLRL
YPAGPLLFPHESSADCVISGYNIPRGTMLIVNQWAIHHDPKVWDDPETFKPERFQGLEGT
RDGFKLMPFGSGRRGCPGEGLAIRLLGMTLGSVIQCFDWERVGDEMVDMTEGLGVTLPKA
VPLVAKCKPRSEMTNLLSEL
```

FIGURE 13A

*S. cerevisiae* CPR polypeptide encoded by NCP1 (SEQ ID NO: 166)

```
MPFGIDNTDFTVLAGLVLAVLLYVKRNSIKELLMSDDGDITAVSSGNRDIAQVVTENNKNYLVLYASQTGTAEDYAKKFSKELVAKFNL
NVMCADVENYDFESLNDVPVIVSIFISTYGEGDFPDGAVNFEDFICNAEAGALSNLRYNMFGLGNSTYEFFNGAAKKAEKHLSAAGAIR
LGKLGEADDGAGTTDEDYMAWKDSILEVLKDELHLDEQEAKFTSQFQYTVLNEITDSMSLGEPSAHYLPSHQLNRNADGIQLGPFDLSQ
PYIAPIVKSRELFSSNDRNCIHSEFDLSGSNIKYSTGDHLAVWPSNPLEKVEQFLSIFNLDPETIFDLKPLDPTVKVPFPTPTTIGAAI
KHYLEITGPVSRQLFSSLIQFAPNADVKEKLTLLSKDKDQFAVEITSKYFNIADALKYLSDGAKWDTVPMQFLVESVPQMTPRYYSISS
SSLSEKQTVHVTSIVENFPNPELPDAPPVVGVTTNLLRNIQLAQNNVNIAETNLPVHYDLNGPRKLFANYKLPVHVRRSNFRLPSNPST
PVIMIGPGTGVAPFRGFIRERVAFLESQKKGGNNVSLGKHILFYGSRNTDDFLYQDEWPEYAKKLDGSFEMVVAHSRLPNTKKVYVQDK
LKDYEDQVFEMINNGAFIYVCGDAKGMAKGVSTALVGILSRGKSITTDEATELIKMLKTSGRYQEDVW
```

*Arabidopsis thaliana* CPR polypeptide encoded by ATR1 (SEQ ID NO: 168)

```
1   mtsalyasdl fkqlksimgt dslsddvvlv iattslalva gfvvllwkkt tadrsgelkp
61  lmipkslmak deddldlgsg ktrvsiffgt qtgtaegfak alseeikary ekaavkvidl
121 lddyaadddq yeeklkketl affcvatygd geptdnaarf ykwfteener dikl qqlayg
181 vfalgnrqye hfnkigivld eelckkgakr lievglgddd qsieddfnaw kesl wseldk
241 llkdeddksv atpytavipe yrvvthdprf ttqksmesnv angnttidih hpcrvdvavq
301 kelhtheadr scihlefdis rtgityetgd hvgvyaenhv eiveeagkll ghsldlvfsi
361 hadkedgspl esavpppfpg pctlgtglar yadllnpprk salvalaaya tepseaeklk
421 hltspdgkde ysqwivasqr sllevmaafp sakpplgvff aaiaprlqpr yysisssprl
481 apsrvhvtsa lvygptptgr ihkgvcstwm knavpaeksh ecsgapifir asnfklpsnp
541 stpivmvgpg tglapfrgfl qermalkedg eelgssllff gcrnrqmdfi yedelnnfvd
601 qgviselima fsregaqkey vqhkmmekaa qvwdliseeg ylyvcgdakg mardvhrtlh
661 tivqeqegvs sseaeaivkk lqtegrylrd vw
```

*A. thaliana* CPR polypeptide encoded by ATR2 (SEQ ID NO: 169)

```
1   msssssssts midlmaaiik gepvivsdpa nasayesvaa elssmlienr qfamivttsi
61  avligcivml vwrrsgsgns krveplkplv ikpreeeidd grkkvtiffg tqtgtaegfa
```

FIGURE 13A (cont'd)

121 kalgeeakar yaktrfkivd lddyaaddde yeeklkkedv affflatygd geptdnaarf
181 ykwftegkdr gewlknlkyg vfglgnrqye hfnkvakvvd dilveqgaqr lvqvglgddd
241 qciedd ftaw reslwpeldt llreegdtav atpytaavle yrvsihdsed akfndinlan
301 gngytvfdaq hpykanvavk relhtpesdr scihlefdia gsglnmklgd hvgvlcdnls
361 etvdeairll dmspdtyfsl haekedgtpi ssslpppfpp cnlrtaltry acllsspkks
421 alvalaahas dpteaerlkh laspagkdey skwvvesqrs llevmaefps akppigvffa
481 gvaprlqprf ysissspkia etrihvtcal vyekmptgri hkgvcstwmk navpyeksek
541 lfigkpifvr qsnfklpsds kvpiimigpg tglapfrgfl qerlalveeg velgpsvlff
601 gcrnrrmdfi yeeelqrfve sgalseltva fsregptkey vqhkmmdkas diwnmisqga
661 ylyvcgdakg marcvhrslh tieqeqgsmd stkaegfvkn lqtsgrylrd vw

*Stevia rebaudiana* CPR7 (SEQ ID NO: 169)

MQSSSVEASTIDLMTAVLKDTVIDTAGASDNQDSKNPPALAMMFESRDLLLILTTSVAVLVGCFVVLVWKRSSGKKSGKELEPPKIVVP
KRRLEQEVDDGKKKVTIFFGTQTGTAEGFAKALFEEAKARYEKAAFKVIDLDDYAADLDEYAEKLKKETIAFFFLATYGDGEPTDNAAK
FYKWFTEGDEKGVWLQKLQYGVFGLGNRQYEHFNKIGIVVDDGLTEQGAKRIVPVGLGDDDQSIEDDFSAWKELVWPELDLLLRDEDDK
AAATPYTAAIPEYRVVFHDKPDAFSDDHTQTNGHAVHDAQHPCRSNVAVKKELHTPESDRSCTHLEFDISHTGLSYETGDHVGVYCENL
IEVVEEAGKLLGLSTDTYFSLHIDNEDGSPLGGPSLQPPFPPCTLRKALTNYADLLSSPKKSTLLALAAHASDPTEADRLRFLASREGK
DEYAEWVVANQRSLLEVMEAFPSARPPLGVFFAAVAPRLQPRYYSISSSPKMEPNRIHVTCALVYEKTPAGRIHKGICSTWMKNAVPLT
ESQDCSWAPIFVRTSNFRLPIDPKVPVIMIGPGTGLAPFRGFLQERLALKESGTELGSSILFFGCRNRKVDYIYENELNNFVENGALSE
LDVAFSRDGPTKEYVQHKMTQKASEIWNMLSEGAYLYVCGDAKGMAKDVHRTLHTIVQEQGSLDSSKAELYVKNLQMSGRYLRDVW

*Stevia rebaudiana* CPR8 (SEQ ID NO: 170)

MQSNSVKISPLDLVTALFSGKVLDTSNASESGESAMLPTIAMIMENRELLMILTTSVAVLIGCVVVLVWRRSSTKKSALEPPVIVVPKR
VQEEEVDDGKKKVTVFFGTQTGTAEGFAKALVEEAKARYEKAVFKVIDLDDYAADDDEYEEKLKKESLAFFFLATYGDGEPTDNAARFY
KWFTEGDAKGEWLNKLQYGVFGLGNRQYEHFNKIAKVVDDGLVEQGAKRLVPVGLGDDDQCIEDDFTAWRELVWPELDQLLRDEDDTTV
ATPYTAAVAEYRVVFHEKPDALSEDYSYTNGHAVHDAQHPCRSNVAVKKELHSPESDRSCTHLEFDISNTGLSYETGDHVGVYCENLSE
VVNDAERLVGLPPDTYSSIHTDSEDGSPLGGASLPPPFPPCTLRKALTCYADVLSSPKKSALLALAAHATDPTEADRLKFLASPAGKDE
YSQWIVASQRSLLEVMEAFPSAKPSLGVFFASVAPRLQPRYYSISSSPKMAPDRIHVTCALVYEKTPAGRIHKGVCSTWMKNAVPMTES
QDCSWAPIYVRTSNFRLPSDPKVPVIMIGPGTGLAPFRGFLQERLALKEAGTDLGLSILFFGCRNRKVDFIYENELNNFVETGALSELI
VAFSREGPTKEYVQHKMSEKASDIWNLLSEGAYLYVCGDAKGMAKDVHRTLHTIVQEQGSLDSSKAELYVKNLQMSGRYLRDVW

FIGURE 13B

>ATR1 codon optimized by DNA2.0. (SEQ ID NO: 171)

ATGACTTCTCCACTTTATGCCTCCGATCTTTTCAAACAATTGAAAAGTATCATGGGAACGGATTCTTTGTCCGATGATGTTGTATTAGT
TATTGCTACAACTTCTCTGGCACTGGTTGCTGGTTTCGTTGTCTTATTGTGGAAAAAGACCACGGCAGATCGTTCCGGCGAGCTAAAGC
CACTAATGATCCCTAAGTCTCTGATGGCGAAAGATGAGGATGATGACTTAGATCTAGGTTCTGGAAAAACGAGAGTCTCTATCTTCTTC
GGCACACAAACCGGAACAGCCGAAGGATTCGCTAAAGCACTTTCAGAAGAGATCAAAGCAAGATACGAAAAGGCGGCTGTAAAAGTAAT
CGATTTGGATGATTACGCTGCCGATGATGACCAATATGAGGAAAAGTTGAAAAAGGAAACATTGGCTTTCTTTTGTGTAGCCACGTATG
GTGATGGTGAACCAACCGATAACGCCGCAAGATTCTACAAGTGGTTTACTGAAGAGAACGAAAGAGATATCAAGTTGCAGCAACTTGCT
TACGGCGTTTTTGCCTTAGGTAACAGACAATACGAGCACTTCTAACAAGATAGGTATTGTCTTAGATGAAGAGTTATGCAAAAAGGGTGC
GAAGAGATTGATTGAAGTCGGTTTAGGAGATGATGATCAATCTATCGAGGATGACTTTAATGCATGGAAGGAATCTTTGTGGTCTGAAT
TAGATAAGTTACTTAAGGACGAAGATCATAAATCCGTTGCCACTCTATACACAGCCGTCATTCCAGAATATAGAGTAGTTACCCATGAT
CCAAGATTCACAACTACAGAAATCGATGCAAAGTAATGTGGCTAATGGTAATACTACCATCGATATTCATCATCCATGTAGAGTAGACGT
TGCAGTTCAAAAGGAATTGCACACTCATGAATCAGACAGATCTTGCATACATCTTGAATTTGATATATCACGTACTGGTATCACTTACG
AAACAGGTGATCACGTGGGTGTCTACGCTGAAAACCATGCTGAAATTGTAGAGGAAGCTGGAAAGTTGTTGGGCCATAGTTTAGATCTT
GTTTTCTCAATTCATGCCGATAAAGAGGATGGCTCACCACTAGAAAGTGCAGTGCCTCCACCATTTCCAGGACCATGCACCCTAGGTAC
CGGTTTAGCTCGTTACGCGGATCTGTTAAATCCTCCACGTAAATCAGCTCTAGTGGCCTTGGCTGCGTACGCCACAGAACCTTCTGAGG
CAGAAAAACTGAAACATCTAACTTCACCAGATGGTAAGGATGAATACTCACAATGGATAGTAGCTAGTCAACGTTCTTTACTAGAAGTT
ATGGCTGCTTTCCCATCGGCTAAACCTCCTTTGGGTGTTTTCTTCGCCGCAATAGCGCCTAGACTGCAACCAAGATACTATTCAATTTC
ATCCTCACCTAGACTGGCACCATCAAGAGTTCATGTCACATGCGCTTTAGTGTACGGTCCAACTCCTACTGGTAGAATCCATAAGGGG
TTTGTTCAACATGGATGAAAAACGCGGTTCCAGCAGAGAAGTCTCACGAATGTTCTGGTGCTCCAATCTTTATCAGAGCCTCGAACTTC
AAACTGCCTTCCAATCCTTCTACTCCTATTGTCATGGTCGGTCCTGGTACAGGTCTTGCTCCATTCAGAGGTTTCTTACAAGAGAGAAT
GGCCTTAAAGGAGGATGGTGAAGAGTTGGGATCTTCTTTGTTGTTTTTCGGCTGTAGAAACAGACAAATGGATTTCATCTACGAAGATG
AACTGAATAACTTTGTAGATCAAGGAGTTATTTCAGAGTTGATAATGGCTTTTTCTAGAGAAGGTGCTCAGAAGGAGTACGTCCAACAC
AAAATGATGGAAAAGGCCGCACAAGTTTGGGACTTAATCAAAGAGGAAGGCTATCTATATGTCTGTGGTGATGCAAAGGGTATGGCAAG
AGATGTTCACAGAACACTTCATACTATAGTCCAGGAACAGGAAGGCGTTAGTTCTTCTGAAGCGGAAGCAATTGTGAAAAAGTTACAAA
CAGAGGGAAGATACTTGAGAGATGTGTGGTAA

FIGURE 13B (cont'd)

>ATR2 codon optimized by Genscript (SEQ ID NO: 172)

ATGTCTTCCTCTTCCTCTTCCAGTACCTCTATGATTGATTTGATGGCTGCTATTATTAAAGGTGAACCAGTTATCGTCTCCGACCCAGC
AAATGCCTCTGCTTATGAATCAGTTGCTGCAGAATTGTCTTCAATGTTGATCGAAAACAGACAATTCGCCATGATCGTAACTACATCA
TCGCTGTTTTGATCGGTTGTATTGTCATGTTGGTATGGAGAAGATCCGGTAGTGGTAATTCTAAAAGAGTCGAACCTTTGAAACCATTA
GTAATTAAGCCAAGAGAAGAAGAAATAGATGACGGTAGAAAGAAAGTTACAATATTTTTCGGTACCCAAACTGGTACAGCTGAAGGTTT
TGCAAAAGCCTTAGCTGAAGAAGCTAAGGCAAGATACGAAAAGACCAGATTCAAGATAGTCGATTTGGATGACTATGCCGCTGATGACG
ATGAATACGAAGAAAAGTTGAAGAAAGAAGATGTTGCATTTTTCTTTTTGGCAACCTATGGTGACGGTGAACCAACTGACAATGCAGCC
AGATTCTACAAATGGTTTACAGAGGGTAATGATCGTGGTGAATGGTTGAAAAACTTAAAGTACGGTGTTTTCGGTTTGGGTAACAGACA
ATACGAACATTTCAACAAAGTTGCAAAGGTTGTCGACGATATTTTGGTCGAACAAGGTGCTCAAAGATTAGTCCAAGTAGGTTTGGGTG
ACGATGACCAATGTATAGAAGATGACTTTACTGCCTGGAGAGAAGCTTTGTGGCCTGAATTAGACACAATCTTGAGAGAAGAAGGTGAC
ACCGCCGTTGCTACCCCATATACTGCTGCAGTATTAGAATACAGAGTTTCCATCCATGATAGTGAAGACGCAAAGTTTAATGATATCAC
TTTGGCCAATGGTAACGGTTATACAGTTTTCGATGCACAACACCCTTACAAAGCTAACGTTGCAGTCAAGAGAGAATTACATACACCAG
AATCCGACAGAAGCTGTATACACTTGGAATTTGATATCGCTGGTTCCGGTTTAACCATGAAGTTGGGTGACCATGTAGGTGTTTTATGC
GACAATTTGTCTGAAACTGTTGATGAAGCATTGAGATTGTTGGATATGTCCCCTGACACTTATTTTAGTTTGCACGCTGAAAAAGAAGA
TGGTACACCAATTTCCAGTTCTTTACCACCTCCATTCCCTCCATGTAACTTAAGAACAGCCTTGACCAGATACGCTTGCTTGTTATCAT
CCCCTAAAAAGTCCGCCTTGGTTGCTTTAGCCGCTCATGCTAGTGATCCTACTGAAGCAGAAAGATTGAAACACTTAGCATCTCCAGCC
GGTAAAGATGAATATTCAAAGTGGGTAGTTGAATCTCAAAGATCATTGTTAGAAGTTATGGCAGAATTCCCATCTGCCAAGCCTCCATT
AGGTGTCTTCTTTGCTGGTGTAGCACCTAGATTGCAACCAAGATTCTACTCAATCAGTTCTTCACCTAAGATCGCTGAAACTAGAATTC
ATGTTACATGTGCATTAGTCTACGAAAAGATGCCAACCGGTAGAATTCACAAGGGTGTATGCTCTACTTGGATGAAAAATGCTGTTCCT
TACGAAAAATCAGAAAAGTTGTTCTTAGGTAGACCAATCTTCGTAAGACAATCAAACTTCAAGTTGCCTTCTGATTCAAAGGTTCCAAT
AATCATGATAGGTCCTGGTACAGGTTTAGCCCCATTCAGAGGTTTCTTGCAAGAAAGATTGGCTTTAGTTGAATCTGGTGTCGAATTAG
GTCCTTCAGTTTTGTTCTTTGGTTGTAGAAACAGAAGAATGGATTTCATCTATGAAGAAGAATTGCAAAGATTCGTCGAATCTGGTGCA
TTGGCCGAATTATCTGTAGCTTTTTCAAGAGAAGGTCCAACTAAGGAATACGTTCAACATAAGATGATGGATAAGGCATCCGACATATG
GAACATGATCAGTCAAGGTGCTTATTTGTACGTTTGCGGTGACGCAAAGGGTATGGCCAGAGATGTCCATAGATCTTTGCACACAATTG
CTCAAGAACAAGGTTCCATGGATAGTACCAAAGCTGAAGGTTTCGTAAAGAACTTACAAACTTCCGGTAGATACTTGAGAGATGTCTGG
TGA

FIGURE 13B (cont'd)

*Stevia rebaudiana* CPR7 (SEQ ID NO: 173; cloned from *S. rebaudiana* cDNA)

ATGCAATCGGAATCCGTTGAAGCATCGACGATTGATTTGATGACTGCTGTTTTGAAGGACACAGTGATCGATACAGCGAACGCATCTGA
TAACGGAGACTCAAAGATGCCGCCGGCGTTGGCGATGATGTTCGAAATTCGTGATCTGTTGCTGATTTTGACTACGTCAGTTGCTGTTT
TGGTCGGATGTTTCGTTGTTTTGGTGTGGAAGAGATCGTCCGGGAAGAAGTCCGGCAAGGAATTGGAGCCGCCGAAGATCGTTGTGCCG
AAGAGGCGGCTGGAGCAGGAGGTTGATGATGGTAAGAAGAAGGTTACGATTTTCTTCGGAACACAAACTGGAACGGCTGAAGGTTTCGC
TAAGGCACTTTTCGAAGAAGCGAAAGCGCGATATGAAAAGGCAGCGTTTAAAGTGATTGATTTGGATGATTATGCTGCTGATTTGGATG
AGTATGCAGAGAAGCTGAAGAAGGAAACATATGCTTTCTTCTTCTTGGCTACATATGGAGATGGTGAGCCAACTGATAATGCTGCCAAA
TTTTATAAATGGTTTACTGAGGGAGACGAGAAAGGCGTTTGGCTTCAAAAACTTCAATATGGAGTATTTGGTCTTGGCAACAGACAATA
TGAACATTTCAACAAGATTGGAATAGTGGTTGATGATGGTCTCACCGAGCAGGGTGCAAAACGCATTGTTCCCGTTGGTCTTGGAGACG
ACGATCAATCAATTGAAGACGATTTTTCGGCATGGAAAGAGTTAGTGTGGCCCGAATTGGATCTATTGCTTCGCGATGAAGATGACAAA
GCTGCTGCAACTCCTTACACAGCTGCAATCCCTGAATACCGCGTGGTATTTCATGACAAACCCGATGCGTTTTCTGATGATCATACTCA
AACCAATGGTCATGCTGTTCATGATGCTCAACATCCATGCAGATCCAATGTGGCTGTTAAAAAAGAGCTTCATACTCCTGAATCCGATC
GTTCATGCACACATCTTGAATTTGACATTTCTCACACTGGATTATCTTATGAAACTGGGGATCATGTTGGTGTATACTGTGAAAACCTA
ATTGAAGTAGTGGAAGAAGCTGGGAAATTGTTAGGATTATCAACAGATACTTATTTCTCGTTACATATTGATAACGAAGATGGTTCACC
ACTTGGTGGACCTTCATTACAACCTCCTTTTCCTCCTTGTACTTTAAGAAAAGCATTGACTAATTATGCAGATCTGTTAAGCTCTCCCA
AAAAGTCAACTTTGCTTGCTCTAGCTGCTCATGCTTCCGATCCCACTGAAGCTGATCGTTTAAGATTTCTTGCATCTCGCGAGGGCAAG
GATGAATATGCTGAATGGGTTGTTGCAAACCAAAGAAGTCTTCTTGAAGTCATGGAAGCTTTCCCGTCAGCTAGACCGCCACTTGGTGT
TTTCTTTGCAGCGGTTGCACCGCGTTTACAGCCTCGTTACTACTCTATTTCTTCCTCCCCAAAGATGGAACCAAACAGGATTCATGTTA
CTTGCGCGTTGGTTTATGAAAAAACTCCCGCAGGTCGTATCCACAAAGGAATCTGCTCAACCTGGATGAAGAACGCTGTACCTTTGACC
GAAACTCAAGATTGCAGTTGGGCACCGATTTTTGTTAGAACATCAAACTTCAGACTTCCAATTGACCCGAAAGTCCCGGTTATCATGAT
TGGTCCTGGAACCGGGTTGGCTCCATTTAGGGGTTTTCTTCAAGAAAGATTGGCTCTTAAAGAATCCGGAACCGAACTCGGGTCATCTA
TTTTATTCTTCGGTTGTAGAAACCGCAAAGTGGATTACATATATGAGAATGAACTCAACAACTTTGTTGAAAATGGTGCGCTTTCTGAG
CTTGATGTTGCTTTCTCCCGCGATGGCCCGACGAAAGAATACGTGCAACATAAAATGACCCAAAAGGCTTCTGAAATATGGAATATGCT
TTCTGAGGGAGCATATTTATATGTATGTGGTGATGCTAAAGGCATGGCTAAAGATGTACACCGTACACTTCACACCATTGTGCAAGAAC
AGGGAAGTTTGGACTCGTCTAAAGCGGAGTTGTATGTGAAGAATCTACAAATGTCAGGAAGATACCTCCGTGATGTTTGGTAA

FIGURE 13B (cont'd)

*Stevia rebaudiana* CPR8 (SEQ ID NO: 174; CPR cloned from *S. rebaudiana* cDNA)

ATGCAATCTAACTCCGTGAAGATTTCGCCGCTTGATCTGGTAACTGCGCTGTTTAGCGGCAAGGTTTTGGACACATCGAACGCATCGGA
ATCGGGAGAATCTGCTATGCTGCCGACTATAGCGATGATTATGGAGAATCGTGAGCTGTTGATGATACTCACAACGTCGGTTGCTGTAT
TGATCGGATGCGTTGTCGTTTTGGTGTGGCCGAGATCGTCTACGAACGAGTCGGCGTTGGAGCCACCGGTGATTGTGGTTCCGAAGAGA
GTGCAAGAGGAGGAAGTTGATGATGGTAAGAAGAAAGTTACGGTTTTCTTCGGCACCCAAACTGGAACAGCTGAAGGCTTCGCTAAGGC
ACTTGTTGAGGAAGCTAAAGCTCGATATGAAAAGGCTGTCTTTAAAGTAATTGATTTGGATGATTATGCTGCTGATGACGATGAGTACG
AGCAGAAACTAAAGAAAGAATCTTTGGCCTTTTTCTTTTTGGCTACGTATGGAGATGGTGAGCCAACAGATAATGCTGCCAGATTTTAT
AAATGGTTTACTGAGGGAGATGCGAAAGGAGAATGGCTTAATAAGCTTCAATATGGAGTATTTGGTTTGGGTAACAGACAATATGAACA
TTTTAACAAGATCGCAAAAGTGGTTGATGATGGTCTTGTAGAACAGGGTGCAAAGCGTCTTGTTCCTGTTGGACTTGGAGATGATGATC
AATGTATTGAAGATGACTTCACCGCATGGAAAGAGTTAGTATGGCCGGAGTTGGATCAATTACTTCGTGATGAGGATGACACAACTGTT
GCTACTCCATACACAGCTGCTGTTGCAGAATATCGCGTTGTTTTTCATGAAAAACCAGACGCGCTTTCTGAAGATTATAGTTATACAAA
TGCCCATGCTCTTCATCATGCTCAACATCCATGCAGATCCAACGTGGCTGTCAAAAAGGAACTTCATAGTCCTGAATCTGACCGGTCTT
GCACTCATCTTGAATTTGACATCTCGAACACCGGACTATCATATGAAACTGGGGATCATGTTGGAGTTTACTGTGAAAACTTGAGTGAA
GTTGTGAATGATGCTGAAAGATTAGTAGGATTACCACCAGACACTTACTCCTCCATTCACACTGACAGTGAAGACGGGTCGCCACTTGG
CGGAGCCTCATTGCCGCCTCCTTTCCCGCCATGCACTTTAAGGAAAGCATTGACGTGTTATGCTGATGTTTTGAGTTCTCCCAAGAAGT
CGGCTTTGCTTGCACTAGCTGCTCATGCCACCGATCCCAGTGAAGCTGATAGATTGAAATTTCTTGCATCCCCCGCCGGAAAGGATGAA
TATTCTCAATGGATAGTTGCAAGCCAAAGAAGTCTCCTTGAAGTCATGGAAGCATTCCCGTCAGCCAAGCCTTCACTTGGTGTTTTCTT
TGCATCTGTTGCCCCGCGCTTACAACCAAGATACTACTCTATTTCTTCCTCACCCAAGATGGCACCGGATAGGATTCATGTTACATGTG
CATTAGTCTATGAGAAAACACCTGCAGGCCGCATCCACAAAGGAGTTTGTTCAACTTGGATGAAGAACGCAGTGCCTATGACCGAGAGT
CAAGATTGCAGTTGGGCCCCAATATACGTCCGAACATCCAATTTCAGACTACCATCTGACGCTAAGGTCCCGGTTATCATGATTGGACC
TGGCACTGGTTTGGCTCCTTTTAGAGGTTTCCTTCAAGAGCGGTTAGCTTTAAAGGAAGCCGGAACTGACCTCGGTTTATCCATTTTAT
TCTTCGGATGTAGGAATCGCAAAGTGGATTTCATATATGAAAACGAGCTTAACAACTTTGTGGAGACTGGTGCTCTTTCTGAGCTTATT
GTTGCTTTCTCCCGTGAAGGCCCGACTAAGGAATATGTGCAACACAAGATGAGTGAGAAGGCTTCGGATATCTGGAACTTGCTTTCTGA
AGGAGCATATTTATACGTATGTGGTGATGCCAAAGGCATGGCCAAAGATGTACATCGAACCCTCCACACAATTGTGCAAGAACAGGGAT
CTCTTGACTCGTCAAAGGCAGAACTCTACGTGAAGAATCTAGAAATGTCAGGAAGATACCTCCGTGACGTTTGGTAA

FIGURE 14

A. *Zea mays* CDPS nucleotide (SEQ ID NO: 157)

```
atggttttgt cttcttcttg tactacagta ccacacttat cttgattagc tgtcgtgcaa     60
cttggtcctt ggagcagtag gattaaaaag aaaaccgata ctgttgcagt accagccgct    120
gcaggaaggt ggagaagggc cttggctaga gcacagcaca catcagaatc cgcagctgtc    180
gcaaaggcca gcagtttgac ccctatagtg agaactgacg ctgagtcaag gagaacaaga    240
tggccaaccg atgacgatga cgccgaacct ttagtggatg agatcagggc aatgcttact    300
tccatgtctg atggtgacat ttccgtgagc gcatacgata cagcctgggt cggattggtt    360
ccaagattag acggcggtga aggtcctcaa ttcccagcag ctgtgacatg gataagaaat    420
aaccagttgc ctgacggaag ttggggcgat gccgcattat tctctgccta tgacaggctt    480
atcaatacct ctgcctgcgt tgtaactctg acaaggtggt ccctagaacc agagatgaga    540
ggtaggggac tatcttcctt gggtaggaat atgtggaaat tagcaactga agatgaagag    600
tcaatgccta ttggcttcga attagccttt ccatctttga tagagctgcc taagagccta    660
ggtgtcctcg acttcccttc tgatacacag gccctacaag gaatctactc ttcaagagag    720
atccaaatga agaagacttc aaaccaactg atgcatacag ttccaacatc aatatccaac    780
agcttggagg gtatgcctgg cctagactgg gctaaactac ctaaactaca gagcagcgat    840
ggaagcttct tgttctcacc agatgccact gctcatgctt taatgaatac cggagatgac    900
aggtgcttta gctacatcga tagaacagta aagaaattca acggcgggat ccctaatgtt    960
tatcccagtg atctatttga acatatttgg gccgttgata gacttgaaag atatggactc   1020
tccaggtact tccaaaagga gatcgaacaa tgcatggatt atgtaaacag gcattggact   1080
gaggacggta ttgtttgggc aaggaactat gatgtaaaag aggtggacga aacagctatg   1140
gcctttagac ttcttaggtt gcacggctac agcgtcagtc ctgatgtgtt taaaaacctc   1200
gaaaaggacg gtgaattttt cgcatttgtc ggacagtcta atcaagctgt taccggtatg   1260
tacaacctaa acagagcaag ccagatatcc ttcccaggcg aggatgtgct tcatagagct   1320
ggtgcattct catatgagtt cttgaggaga aaagaagcag agggagctct gagggacaag   1380
tggatcattt ctaaagatct acctggtgaa gttgtgtata cttcggattc tccatggtac   1440
ggcaacttac ctagagtcga ggccagacac tacctagagc aatacggagg tggtgatgac   1500
gtttggattg gcaagacatt gtataggatg ccactcgtaa acaatgatgt atatttggaa   1560
ttggcaagaa tggatttcaa ccactgccag gctttgcatc agttagagtg gcaaggacta   1620
aaaagatggt atactgaaaa taggttgatg gacttcggtg tcgcccaaga agatgccctt   1680
```

FIGURE 14A (cont'd)

```
agaggttatt ttcctgcagc cgcatccgtt tacgagcctt gtagagctgc cgagaggctt      1740
gcctgggctc gagccgcaat actagctacc gccgtgagca ccaacttaag acataggcca      1800
tcattcagag aaaggttaga gcattctctt agtgatagac ctagtgaaga gacagatgac      1860
tcctagttta actcctcaac tggctcgcat gaagttttag taaaggctgt cttaagactt      1920
actgattcat tagcaaggga agcacagcca atccatgggg gtgacccaga agatattata      1980
cacaagttgt taagatctgc ttgggccgag tgggttaggg aaaaggcaga cgctgccgat      2040
agcgtgtgca atggtagttc tgcagtcgaa cacgaaggat cacgaatggt ccatgataaa      2100
cagacctgtc tattatcggc tagaatgatc gaaattcctg ccggtagggc agctggtgaa      2160
gcagccagtc aggacggcga tagaagaata attcaattaa caggctcact atgcgacagt      2220
cttaagcaaa aaatgctagt ttcacaggac cctgaaaaaa atgaagagat gatgtctcac      2280
gtggatgacg aattgaagtt gaggattaga gagttcgttc aatatttgct tagactaggt      2340
gaaaaaaaga ctggatctag cgaaacgagg caaacatttt taagtacagt gaaatcatgt      2400
tactatgctg ctcattgccc acttcatgtc gttgatagac acttagttag agtgatttcc      2460
gagccagtaa gtgccgcaaa gtaacagcgg                                       2490
```

B. *Zea mays* CDPS polypeptide (SEQ ID NO: 158)

```
Met Val Leu Ser Ser Ser Cys Thr Thr Val Pro His Leu Ser Ser Leu
1               5                   10                  15
Ala Val Val Gln Leu Gly Pro Trp Ser Ser Arg Ile Lys Lys Lys Thr
            20                  25                  30
Asp Thr Val Ala Val Pro Ala Ala Ala Gly Arg Trp Arg Arg Ala Leu
        35                  40                  45
Ala Arg Ala Gln His Thr Ser Glu Ser Ala Ala Val Ala Lys Gly Ser
    50                  55                  60
Ser Leu Thr Pro Ile Val Arg Thr Asp Ala Glu Ser Arg Arg Thr Arg
65                  70                  75                  80
Trp Pro Thr Asp Asp Asp Asp Ala Glu Pro Leu Val Asp Glu Ile Arg
                85                  90                  95
Ala Met Leu Thr Ser Met Ser Asp Gly Asp Ile Ser Val Ser Ala Tyr
            100                 105                 110
Asp Thr Ala Trp Val Gly Leu Val Pro Arg Leu Asp Gly Gly Glu Gly
```

FIGURE 14B (cont'd)

```
        115                 120                 125
Pro Gln Phe Pro Ala Ala Val Arg Trp Ile Arg Asn Asn Gln Leu Pro
    130                 135                 140
Asp Gly Ser Trp Gly Asp Ala Ala Leu Phe Ser Ala Tyr Asp Arg Leu
145                 150                 155                 160
Ile Asn Thr Leu Ala Cys Val Val Thr Leu Thr Arg Trp Ser Leu Glu
                165                 170                 175
Pro Glu Met Arg Gly Arg Gly Leu Ser Phe Leu Gly Arg Asn Met Trp
            180                 185                 190
Lys Leu Ala Thr Glu Asp Glu Glu Ser Met Pro Ile Gly Phe Glu Leu
        195                 200                 205
Ala Phe Pro Ser Leu Ile Glu Leu Ala Lys Ser Leu Gly Val His Asp
    210                 215                 220
Phe Pro Tyr Asp His Gln Ala Leu Gln Gly Ile Tyr Ser Ser Arg Glu
225                 230                 235                 240
Ile Lys Met Lys Arg Ile Pro Lys Glu Val Met His Thr Val Pro Thr
                245                 250                 255
Ser Ile Leu His Ser Leu Glu Gly Met Pro Gly Leu Asp Trp Ala Lys
            260                 265                 270
Leu Leu Lys Leu Gln Ser Ser Asp Gly Ser Phe Leu Phe Ser Pro Ala
        275                 280                 285
Ala Thr Ala Tyr Ala Leu Met Asn Thr Gly Asp Asp Arg Cys Phe Ser
    290                 295                 300
Tyr Ile Asp Arg Thr Val Lys Lys Phe Asn Gly Gly Val Pro Asn Val
305                 310                 315                 320
Tyr Pro Val Asp Leu Phe Glu His Ile Trp Ala Val Asp Arg Leu Glu
                325                 330                 335
Arg Leu Gly Ile Ser Arg Tyr Phe Gln Lys Glu Ile Glu Gln Cys Met
            340                 345                 350
Asp Tyr Val Asn Arg His Trp Thr Glu Asp Gly Ile Cys Trp Ala Arg
        355                 360                 365
```

FIGURE 14B (cont'd)

```
Asn Ser Asp Val Lys Glu Val Asp Asp Thr Ala Met Ala Phe Arg Leu
    370                 375                 380
Leu Arg Leu His Gly Tyr Ser Val Ser Pro Asp Val Phe Lys Asn Phe
385                 390                 395                 400
Glu Lys Asp Gly Glu Phe Phe Ala Phe Val Gly Gln Ser Asn Gln Ala
                405                 410                 415
Val Thr Gly Met Tyr Asn Leu Asn Arg Ala Ser Gln Ile Ser Phe Pro
            420                 425                 430
Gly Glu Asp Val Leu His Arg Ala Gly Ala Phe Ser Tyr Glu Phe Leu
        435                 440                 445
Arg Arg Lys Glu Ala Glu Gly Ala Leu Arg Asp Lys Trp Ile Ile Ser
    450                 455                 460
Lys Asp Leu Pro Gly Glu Val Val Tyr Thr Leu Asp Phe Pro Trp Tyr
465                 470                 475                 480
Gly Asn Leu Pro Arg Val Glu Ala Arg Asp Tyr Leu Glu Gln Tyr Gly
                485                 490                 495
Gly Gly Asp Asp Val Trp Ile Gly Lys Thr Leu Tyr Arg Met Pro Leu
            500                 505                 510
Val Asn Asn Asp Val Tyr Leu Glu Leu Ala Arg Met Asp Phe Asn His
        515                 520                 525
Cys Gln Ala Leu His Gln Leu Glu Trp Gln Gly Leu Lys Arg Trp Tyr
    530                 535                 540
Thr Glu Asn Arg Leu Met Asp Phe Gly Val Ala Gln Glu Asp Ala Leu
545                 550                 555                 560
Arg Ala Tyr Phe Leu Ala Ala Ala Ser Val Tyr Glu Pro Cys Arg Ala
                565                 570                 575
Ala Glu Arg Leu Ala Trp Ala Arg Ala Ala Ile Leu Ala Asn Ala Val
            580                 585                 590
Ser Thr His Leu Arg Asn Ser Pro Ser Phe Arg Glu Arg Leu Glu His
        595                 600                 605
```

FIGURE 14B (cont'd)

```
Ser Leu Arg Cys Arg Pro Ser Glu Glu Thr Asp Gly Ser Trp Phe Asn
    610                 615                 620
Ser Ser Ser Gly Ser Asp Ala Val Leu Val Lys Ala Val Leu Arg Leu
625                 630                 635                 640
Thr Asp Ser Leu Ala Arg Gln Ala Gln Pro Ile His Gly Gly Asp Pro
                645                 650                 655
Glu Asp Ile Ile His Lys Leu Leu Arg Ser Ala Trp Ala Glu Trp Val
            660                 665                 670
Arg Glu Lys Ala Asp Ala Ala Asp Ser Val Cys Asn Gly Ser Ser Ala
        675                 680                 685
Val Glu Gln Glu Gly Ser Arg Met Val His Asp Lys Gln Thr Cys Leu
    690                 695                 700
Leu Leu Ala Arg Met Ile Glu Ile Ser Ala Gly Arg Ala Ala Gly Glu
705                 710                 715                 720
Ala Ala Ser Glu Asp Gly Asp Arg Arg Ile Ile Gln Leu Thr Gly Ser
                725                 730                 735
Ile Cys Asp Ser Leu Lys Gln Lys Met Leu Val Ser Gln Asp Pro Glu
            740                 745                 750
Lys Asn Glu Glu Met Met Ser His Val Asp Asp Glu Leu Lys Leu Arg
        755                 760                 765
Ile Arg Glu Phe Val Gln Tyr Leu Leu Arg Leu Gly Glu Lys Lys Thr
    770                 775                 780
Gly Ser Ser Glu Thr Arg Gln Thr Phe Leu Ser Ile Val Lys Ser Cys
785                 790                 795                 800
Tyr Tyr Ala Ala His Cys Pro Pro His Val Val Asp Arg His Ile Ser
                805                 810                 815
Arg Val Ile Phe Glu Pro Val Ser Ala Ala Lys
            820                 825
```

FIGURE 15

A. Codon-optimized nucleotide sequence for CDPS-KS (SEQ ID NO:161)

ATGGCTGGTAAAATTGAAAATGGTACCCCAAAGGACCTCAAGACTGGAAATGATTTTGTTTCTGCTGCTAAGAGTTTACTAGATCGAGC
TTTCAAAAGTCATCATTCCTACTACGGGTTAGGCTCAACTTCATGTCAAGTTTATGATACAGCTTGGGTTGCAATGATTCCAAAAAACAA
GAGATAAGGTAAAACAGTCGTCTTTTCCAGAATTTTCCATTACGTTTTAAAAAACACAAGCCCCAGATGGCTCATGGGGTTCATTGCCT
ACAAGACAGACAGCGGGTATCCTAGATACAGCCTCAGCTGTGCTGGCATTATTGTGCCACGCACAAGAGCCTTTACAAATATTGGATGT
ATCTCCAGATGAAATGGGGTTGAGAATAGAACACGGTGTCACATCCTTGAAACGTCAATTAGCAGTTTGGAATGATGTGGAGGACACCA
AGCATATTGGCGTCGAGTTTATCATACCAGCCTTACTTTCCATGGTAGAAAAGGAATTAGATGTTCCATCTTTTGAATTTCCATGTACG
TCCATCTTAGAGAGAATGCACGGCGAGAAATTAGGTCATTTCGACCTGGAACAAGTTTACGGCAAGCCAAGCTCATTGTTGCACTCATT
GGAAGCATTTCTCGGTAAGCTAGATTTTGATCGCTATCACATCACCTATACCACGGCAGTATGATGGCATCTCCATCTTCAACGGCTG
CTTATCTTATTGGGGCTACAAAATGGGATGACGAAGCCGAAGATTACCTAAGACATGTAATGCGTAATGGTGCAGGACATGGGAATGCA
GGTATTTCTGGTACATTCCCAACTACTCATTTCGAATCTAGCTGGATTATAGCAACGTTGTTAAAGGTTGGCTTTACTTTGAAGCAAAT
TGACGGCGATGGCTTAAGAGGCTTATCAACCATCTTACTTGAGGCGCTTGGTGATGAGAATGGTGTCATAGGCTTTGCCCCTAGAACAC
CAGATGTAGATGACACAGCCAAAGCTCTATTGGCCTTGTCATTGGTAAACCAGCCAGTGTCACCTGATATCATGATTAAGGTCTTTGAG
GGCAAAGACCATTTTACCACTTTTGGTTCAGAAAGAGATCCATCATTGACTTCCAACCTGCACGTGCTTTTATCTTTACTTAAACAATC
TAACTTGTCTCAATACCATCCTCAAATCCTCAAAACAACATTATTCACTTGTAGATGGTGGTGGGTTCCGATCATTGTGTCAAAGACA
AATGCAAATTTGAGTCAGCTATATCCAACTATGTTGTTGGTTGAAGCCTTCACTGAAGTGCTCCATCTCATTGACGGTGGTGAATTGTCT
AGTCTGTTTGATGAATCCTTTAAGCTGTAAGATTGGTCTTAGCATCTTTCAAGCGGTACTTAGAATAATCCTCACCCAAGACAACGACGG
CTCTTGGAGAGGATACAGAGAACAGACGTGTTACGCAATATTGGCTTTAGTTCAAGCGAGACATGTATGCTTTTTCACTCACATGGTTG
ACAGACTGCAATCATGTGTTGATCGAGGTTTCTCATGGTTGAAATCTTGCTCTTTTCATTCTCAAGACCTGACTTGGACCTCTAAAACA
GCTTATGAAGTGGGTTTCGTAGCTGAAGCATATAAACTAGCTGCTTTACAATCTGCTTCCCTGGAGGTTCCTGCTGCCACCATTGGACA
TTCTGTCACGTCTGCCGTTCCATCAAGTGATCTTGAAAAATACATGAGATTGGTGAGAAAAACTGCGTTATTCTCTCCACTGGATGAGT
GGGGTCTAATGGCTTCTATCATCGAATCTTCATTTTTCGTACCATTACTGCAGGCACAAAGACTTGAAATATACCCTAGAGATAATATC
AAGGTGGACGAAGATAAGTACTTGTCTATTATCCCATTCACATGGGTCGGATGCAATAATAGGTCTAGAACTTTCGCAAGTAACAGATG
GCTATACGATATGATGTACCTTTCATTACTCGGCTATCAAACGGACGAGTACATGGAAGCTGTAGCTGGGCCAGTGTTTGGGGATGTTT
CCTTGTTACATCAAACAATTGATAAGGTGATTGATAATACAATGGGTAACCTTGCGAGAGCCAATGGAACAGTACACAGTGGTAATGGA
CATCAGCACGAATCTCCTAATATAGGTCAAGTCGAGGACACCTTGACTCGTTTCACAAATTCAGTCTTGAATCACAAAGACGTCCTTAA
CTCTAGCTCATCTGATCAAGATACTTTGAGAAGAGAGTTTAGAACATTCATGCACGCTCATATAACACAAATCGAAGATAACTCACGAT
TCAGTAAGCAAGCCTCATCCGATGCGTTTTCCTCTCCTGAACAATCTTACTTTCAATGGGTGAACTCAACTGCTGGCTCACATGTCCCT
TGCGGTTATTCATTTGCCTTCTCTAATTGCCTCATGTCTGCAAATTTGTTGCAGGGTAAAGACGCATTTCCAAGCGGAACGCAAAAGTA

FIGURE 15 (cont'd)

CTTAATCTCCTCGCTTATGAGACATCCCACAAACATCTGTAGAATGTATAACGACTTTGCCCCTATTCCCAGAGACAACCCTCAGAGAA
ATTTTAATAGTATTCACTTTCCTGAGCTTACTCCCTGTAACCGAACTTCTCAAAACCTAGATGAAAGGAAGGAAAGACTTCTGAAAATC
GCAACTTACGAACGAGGGTATTTGGGTACGGCACTAGAGGCCTTGGAAAGACAGAGTAGAGATGATGCCGGAGACAGAGCTGGATCTAA
AGATATGAGAAAGTTGAAAATCGCTAAGTTATTCTGTGATGTTACGGACTTATACGATCAGCTCTACGTTATCAAAGATTTGTCATCCT
CTATGAAGTAA

B. *Gibberella fujikuroi* CDPS-KS polypeptide(SEQ ID NO:162)
MPGKIENGTPKDLKTGNDFVSAAKSLLDRAFKSHHSYYGLCSTSCQVYDTAWVAMIPKTR
DKVKQWLFPECFHYLLKTQAADGSWGSLPTTQTAGILDTASAVLALLCHAQEPLQILDVS
PDEMGLRIEHGVTSLKRQLAVWNDVEDTNHIGVEFIIPALLSMLEKELDVPSFEFPCRSI
LERMHGEKLGHFDLEQVYGKPSSLLHSLEAFLGKLDFDRLSHHLYHGSMMASPSSTAAYL
IGATKWDDEAEDYLRHVMRNGAGHGNGGISGTFPTTHFECSWIIATLLKVGFTLKQIDGD
GLRGLSTILLEALRDENGVIGFAPRTADVDDTAKALLALSLVNQPVSPDIMIKVFEGKDH
FTTFGSERDPSLTSNLHVLLSLLKQSNLSQYHPQILKTTLFTCRWWWGSDHCVKDKWNLS
HLYPTMLLVEAFTEVLHLIDGGELSSLFDESFKCKIGLSIFQAVLRIILTQDNDGSWRGY
REQTCYAILALVQARHVCFFTHMVDRLQSCVDRGFSWLKSCSFHSQDLTWTSKTAYEVGF
VAEAYKLAALQSASLEVPAATIGHSVTSAVPSSDLEKYMRLVRKTALFSPLDEWGLMASI
IESSFFVPLLQAQRVEIYPRDNIKVDEDKYLSIIPFTWVGCNNRSRTFASNRWLYDMMYL
SLLGYQTDEYMEAVAGPVFGDVSLLHQTIDKVIDNTMGNLARANGTVHSGNGHQHESPNI
GQVEDTLTRFTNSVLNHKDVLNSSSSDQDTLRREFRTFMHAHITQIEDNSRFSKQASSDA
FSSPEQSYFQWVNSTGGSHVACAYSFAFSNCLMSANLLQGKDAFPSGTQKYLISSVMRHA
TNMCRMYNDFGSIARDNAERNVNSIHFPEFTLCNGTSQNLDERKERLLKIATYEQGYLDR
ALEALERQSRDDAGDRAGSKDMRKLKIVKLFCDVTDLYDQLYVIKDLSSSMK

FIGURE 17

A. Native *A. thaliana* SUS1 nucleotide (SEQ ID NO: 175)

ATGGCAAACGCTGAACGTATGATAACGCGCGTCCACAGCCAACGTGAGCGTTTGAACGAAACGCTTGTTTCTGAGAGAAACGAAGTCCT
TGCCTTGCTTTCCAGGGTTGAAGCCAAAGGTAAAGGTATTTTACAACAAAACCAGATCATTGCTGAATTCGAAGCTTTGCCTGAACAAA
CCCGGAAGAAACTTGAAGGTGGTCCTTTCTTTGACCTTCTCAAATCCACTCAGGAAGCAATTGTGTTGCCACCATGGGTTGCTCTAGCT
GTGAGGCCAAGGCCTGGTGTTTGGGAATACTTACGAGTCAATCTCCATGCTCTTGTCGTTGAAGAACTCCAACCTGCTGAGTTTCTTCA
TTTCAAGGAAGAACTCGTTGATGGAGTTAAGAATGGTAATTTCACTCTTGAGCTTGATTTCGAGCCATTCAATGCGTCTATCCCTCGTC
CAACACTCCACAAATACATTGGAAATGGTGTTGACTTCCTTAACCGTCATTTATCGGCTAAGCTCTTCCATGACAAGGAGAGTTTGCTT
CCATTGCTTAAGTTCCTTCGTCTTCACAGCCACCAGGGCAAGAACCTGATGTTGAGCGAGAAGATTCAGAACCTCAACACTCTGCAACA
CACCTTGAGGAAAGCAGAAGAGTATCTAGCAGAGCTTAAGTCCGAAACACTGTATGAAGAGTTTGAGGCCAAGTTTGAGGAGATTGGTC
TTGAGAGGGGATGGGGAGACAATGCAGAGCGTGTCCTTGACATGATACGTCTTCTTTTGGACCTTCTTGAGGCGCCTGATCCTTGCACT
CTTGAGACTTTTCTTGGAAGAGTACCAATGGTGTTCAACGTTGTGATCCTCTCTCCACATGGTTACTTTGCTCAGGACAATGTTCTTGG
TTACCCTGACACTGGTGGACAGGTTGTTTACATTCTTGATCAAGTTCGTGCTCTGGAGATAGAGATGCTTCAACGTATTAAGCAACAAG
GACTCAACATTAAACCAAGGATTCTCATTCTAACTCGACTTCTACCTGATGCGGTAGGAACTACATGCGGTGAACGTCTCGAGAGAGTT
TATGATTCTGAGTACTGTGATATTCTTCGTGTGCCCTTCAGAACAGAGAAGGGTATTGTTCGCAAATGGATCTCAAGGTTCGAAGTCTG
GCCATATCTAGAGACTTACACCGAGGATGCTGCGGTTGAGCTATCGAAAGAATTGAATGGCAAGCCTGACCTTATCATTGGTAACTACA
GTGATGGAAATCTTGTTGCTTCTTTATTGGCTCACAAACTTGGTGTCACTCAGTGTACCATTGCTCATGCTCTTGAGAAAACAAAGTAC
CCGGATTCTGATATCTACTGGAAGAAGCTTGACGACAAGTACCATTTCTCATGCCAGTTCACTGCGGATATTTTCGCAATGAACCACAC
TGATTTCATCATCACTAGTACTTTCCAAGAAATTGCTGGAAGCAAAGAAACTGTTGGGCAGTATGAAAGCCACACAGCCTTTACTCTTC
CCGGATTGTATCGAGTTGTTCACGGGATTGATGTGTTTGATCCCAAGTTCAACATTGTCTCTCCTGGTGCTGATATGAGCATCTACTTC
CCTTACACAGAGGAGAAGCGTAGATTGACTAAGTTCCACTCTGAGATCGAGGAGCTCCTCTACAGCGATGTTGAGAACAAAGAGCACTT
ATGTGTGCTCAAGGACAAGAAGAAGCCGATTCTCTTCACAATGGCTAGGCTTGATCGTGTCAAGAACTTGTCAGGTCTTGTTGAGTGGT
ACGGGAAGAACACCCGCTTGCGTGAGCTAGCTAACTTGGTTGTTGTTGGAGGAGACAGGAGGAAAGAGTCAAAGGACAATGAAGAGAAA
GCAGAGATGAAGAAAATGTATGATCTCATTGAGGAATACAAGCTAAACGGTCAGTTCAGGTGGATCTCCTCTCAGATGGACCGGGTAAG
GAACGGTGAGCTGTACCGGTACATCTGTGACACCAAGGGTGCTTTTGTCCAACCTGCATTATATGAAGCCTTTGGGTTAACTGTTGTGG
AGGCTATGACTTGTGGTTTACCGACTTTCGCCACTTGCAAAGGTGGTCCAGCTGAGATCATTGTGCACGGTAAATCGGGTTTCCACATT
GACCCTTACCATGGTGATCAGGCTGCTGATACTCTTGCTGATTTCTTCACCAAGTGTAAGGAGGATCCATCTCACTGGGATGAGATCTC
AAAAGGAGGGCTTCAGAGGATTGAGGAGAAATACACTTGGCAAATCTATTCACAGAGGCTCTTGACATTGACTGGTGTGTATGGATTCT
GGAAGCATGTCTCGAACCTTGACCGTCTTGAGGCTCGCCGTTACCTTGAAATGTTCTATGCATTGAAGTATCGCCCATTGGCTCAGGCT
GTTCCTCTTGCACAAGATGATTGA

FIGURE 17 (cont'd)

B. *S. rebaudiana* SUS nucleotide (SEQ ID NO: 176) with the mutation that changes S11 to glutamate (E) in bold, lowercase letters

ATGGCGGAACGTGTACTCACTCGTGTTCACgaaCTTCGTGAGCGTCTCGATTCAACTCTCGCAACTCATCGTAATGAAATCCTCTTGTT
TCTTTCAAGGATTGAAAGCCATGGAAAAGGAATATTGAAGCCTCATCAAGTTATGACTGAATTTGAAGCTATCTGCAAAGAAGATCAGA
GCAAACTCTCTGATGGTGCTTTTTATGAAGTTCTTAAATGCACACAGGAAGCAATAGTGCAACCTCCATGGGTTGCACTCGCGATCCGT
CTTCGACCCGGTGTTTGGGAATATGTTAGAGTCAATGTTAATGTTTTGGTGGTTGAAGAATTAAGTGTTCCTGAATATCTTCACTTCAA
AGAAGAATTGGTTAATGGAACATCGAATGGCAACTTCGTGTTGGAACTGGATTTTGAACCTTTTACCGCATCGTTTCCTCGACCAACTT
TAACCAAGTCTATTGGTAATGGTGTTGAGTTTCTAAACAGACATTTATCTGCTAAAATGTTTCATGATAAGGATAGCATGCACCCTCTT
CTTGATTTCCTACGGACTCACCACTATAAGGGAAAGACAATGATGTTGAATGATAGAATCCAAAACCTCAATGCTCTACAATCGGTGTT
GCGAAAGGCGTCAGAGTACTTATCAACACTCGACGCGGCAACACCGTACTCTCAGTTTGAACATAAGTTTCAAGAAATCGGGTTGGAGA
GAGGTTGGGGTGATAAAGCGGAGGTCGTAATGGAGATGATCCACATGCTTCTAGACCTTCTAGAAGCACCCGACGCATGCACACTCGAG
AAGTTTCTCGGAAGAATCCCAATGGTTTTCAATGTTGTCATTCTTTCGCCTCATGGCTACTTCGCGCAAGAAAATGTGTTGGGATATCC
CGACACTGGCGGTCAGGTTGTTTACATCTTGGATCAAGTTCCCGCTCTGGAACGCGAGATGCTCAAAAGGATTAAGGAGCAAGGACTCG
ATATCATTCCTCGTATATTGATTGTTACGAGGCTTCTTCCTGACGCGGTTGGGACCACATGCGGGCAACGTTTAGAGAAAGTGTTTGGA
GCCGAACACTCGCATATTCTTCGGGTCCCGTTTAGAACCGAAAAGGGTATTCTTCGTAAATGGATCTCTCGTTTTGAGGTGTGGCCTTA
CATCGAGACTTTCACCGAGGATGTTGCTAAAGAAGTTACAGCAGAGTTGCAAGCAAAACCAGATTTGATCATTGGAAACTATAGTGAAG
GAAATTTGGTTGCATCTTTGCTAGCTCACAAGTTGGGTGTCACTCAGTGTACCATTGCTCATGCTTTGGAGAAAACTAAATACCCGGAT
TCTGATATCTACTGGAAGAACTTTGAGGAGAAATATCATTTCTCTTCGCAGTTTACCGCTGATCTTATCGCTATGAACCATACCGACTT
CATCATCACCAGTACTTTCCAAGAAATTGCTGGAAGTAAGGACACGGTTGGACAGTACGAGAGTCATACCGCGTTCACAATGCCGGGAT
TGTATCGGGTGGTTCACGGGATCGATGTTTTTGACCCCAAATTCAATATTGTTTCACCCGGGGCCGATATGGGAATTTACTACTCGTAT
ACCGAGAAAGAAAAGAGGCTCACTGCGCTTCACCCTGAAATCGATGAACTTCTCTTTAGTTCCGTCGAAAACGAAGAACACTTATGTGT
GTTGAAGGATAAGAGTAAACCAATCTTGTTCACAATGGCGCGATTGGATAATGTGAAGAATTTAACCGGACTGGTTGAATGGTACGCTA
AAAACGACCGCCTTCGTGAGCTCGTGAACCTCGTGGTCGTCGGTGGTGACCGAAGGAAAGAGTCGAAAGATCTTGAAGAGCAAGCTCAG
ATGAAGAAGATGCATGAACTTATCGAAACCTACAAACTCAACGGTCAGTTCAGGTGGATATCCTCACAAATGAACCGCGTGAGGAACGG
TGAGTTGTATCGCGTTATTGCTGACACGCGAGGTGCGTTTATCCAGCCTGCGTTTTACGAGGCGTTTGGGTTGACGGTTGTGGAGGCCA
TGACTTGTGGCCTGCCGACATTCGCGACACTTCATGGTGGGCCCGCTGAGATTATTGTTCACGGGAAATCCGGGTTCCATATTGACCCG
TATCACGGTGACCAGGTCACCGAGTTGCTGGTCAATTTCTTTGAGAAAACTAAACAAGACCCGGGTCATTGGGAGGCCATTTCCAAGGG
TGGTCTGCAACGTATTCAGGAGAAATACACGTGGCAGATTTATTCAGATAGGTTGTTGACGCTTGCCGGAGTTTATGGATTCTGGAAGC
ATGTGTCGAAGCTTGACAGGCTCGAGATCCGTCGTTATCTTGAAATGTTTTACGCGCTCAAGTATCGCAAACTGGCTGAATCTGTTCCA
TTGGCTGTTGATGAGTGA

FIGURE 17 (cont'd)

C. *Coffea arabica* sus1 nucleotide (SEQ ID NO: 177)

ATGGCCGAACGTGTTCTGACCCGTGTTCACAGCCTCCGCGAACGCCTTGATGCTACTTTGGCTGCCCACCGCAACGATGTTTTGCTGTT
TATGTCGAGGCTTGAAACCCATGGGAAAGGGATCCTGAAACCCCACCAACTTTTGGCTGAGTTTGAAGAAATTAACAAGGATGGTAAAC
AAAAAATTCATGATCATGCCTTTGAAGAAGTCCTGAAGTCCACACAGGAAGCAATTGTGTTGCCCCCCTGGGTTGCACTTGCTATTCGT
CTCAGACCTGGTGTCTGGGAGTATGTTCGAGTCAATGTCCATGCACTCGTTGTTGAGGAGTTAACCGTGCCAGAGTACCTGCATTTCAA
GGAAGAACTCGTTGATGGAAGCAAAAATGGGAATTTTGTTTTGGAACTGGACTTCGAACCATTTACAGCCTCTTTTCCCAAGCCAACTC
TAACTAAGTACATAGGCGACGGAGTTGAGTTCCTCAACAGGCACCTCTCTGCCAAAATGTTCCATGACAAGGAGAGCATGGCCCCTCTC
CTTGATTTTCTCCGTGTTCACCAATACAAGGGCAAGACAATGATGCTTAACGACAGGATCAAGGACCTTAACACTCTCCAAGCAGTTCT
GAGGAAGGCAGAGGAGTACCTAACAACACTCTCTGCAGATACACCATACTCTGAATTCGAGCACAAATTCCAAGAAATTGGACTGGAGA
GAGGTTGGGGTGATACTGCTGAGCGTGTCTTGGAAATGATCTGCATGCTTCTGGATCTTCTGGGGGCTCCTGACTCGTGCACACTAGAG
AAATTCCTAGGGAGAATCCCTATGGTATTCAATGTTGTTATTCTTTCCCCCCATGGATACTTTGCCCAGGAAAACGTATTGGGTTATCC
TGATACCGGTGGCCAGGTTGTTTACATATTGGATCAAGTTCCTGCCTTGGAGCGTGAGATGCTGAAGAGGATAAAGGAACAAGGACTTG
ATGTCAAGCCACGCATTCTAATTATAACTAGGCTGCTTCCTGATGCCCCTGGAACCACTTGTGGTCAACGGCTTGAGAAAGTATATGGA
TCAGAGTACTCCCATATACTCAGAGTCCCCTTCAGAACTGAGAAGGGAGTTGTTCGCAAATGGATCTCTCGCTTTGAAGTTTGGCCCTA
CATGGAAACATTTACTGAGGATGTTGCAAAAGAAGTCACTGCAGAATTACAGGCAAAGCCAGATTTGGTTATTGGTAACTACAGTGAGG
GTAACCTTGTTGCCTCCTTGCTTGCTCACAAGTTAGGTGTAACACAGTGTACCATTGCTCATGCTTTGGAAAAAACCAAGTATCCTGAT
TCTGATATTTATTTGAGCAAATTTGATGAAAAGTACCACTTCTCATGTCAGTTCACTGCGGATCTTATCGCAATGAACCATACAGATTT
CATTATCACTAGCACTTTCCAAGAAATAGCTGGAAGCAAGGACACTGTTGGGCAATATGAAAGCCATATGGCCTTCACAATGCCAGGAT
TATACAGAGTTGTACATGGCATTGATGTTTTTGATCCAAAATTCAACATTGTCTCACCTGGAGCTGATACAAACCTCTACTTCCCACAC
ACAGAGAAGGAAAAGAGATTGACATCTTTCCATCCTGAAATTGAGGAGTTGCTTTTCAGCGATGTGGAGAATGAGGAACACCTATGTGT
GCTAAAAGACAAAAAGAAGCCTATCTTATTCACCATGGCAAGACTGGATCGCGTAAAGAATTTGACAGGGCTTGTTGAATTGTATGCTA
AGAACCCAAAACTAAGGGAATTGGTCAATCTTGTCGTGGTTGGTGGAGACCGAAGGAAGGAATCCAAAGATTTGGAAGAACAAGCTGAG
ATGAAGAAAATGTATTCATTGATAGAAACTTACAACTTGAACGGCCAATTCAGATGGATTTCTTCTCAGATGAACAGGGTTAGAAATGG
TGAACTCTATCGGTACATTGCTGACACCAGGGGAGCATTCGTGCAACCTGCATTTTATGAGGCATTTGGGTTGACTGTGGTCGAGGCCA
TGACATGTGGTTTGCCAACATTTGCAACCAACCATGGTGGTCCTGCTGAGATCATTATTCATGGGAAATCTGGTTTCCACATTGATCCA
TACCATGGTGAGCAGGTCAGCGAGCTCCTTGCCAATTTCTTTGAAAGGTGCAAGAAAGAGCCTTCTTACTGGGACACCATTTCAGCCGG
TGGCTTGAAGCGTATCCAGGAAAAGTACACCTGGCAAATTTACTCAGATCGGTTGCTGACGCTGGCTGGAGTTTATGGATTCTGGAAAT
GTGTTTCCAAGCTTGATCGCCAGGAGATCCGCCGTTATCTGGAAATGTTTTATGCTCTCAAGTATCGCAAGTTGGCTGAAGCTGTTCCA
TTGGCTGTTGATCAGTAA

FIGURE 19

A. *A. thaliana* UDP-glycosyltransferase UGT72E2 polypeptide (SEQ ID NO: 178)

MHITKPHAAMFSSPGMGHVIPVIELGKRLSANNGFHVTVFVLETDAASAQSKFLNSTGVDIVKLPSPDIYGLVDPDDHVVTKIGVIMRA
AVPALRSKIAAMHQKPTALIVDLFGTDALCLAKEFNMLSYVFIPTNARFLGVSIYYPNLDKDIKEEHTVQRNPLAIPGCEPVRFEDTLD
AYLVPDEPVYRDFVRHGLAYPKADGILVNTWEEMEPKSLKSLLNPKLLGRVARVPVYPIGPLCRPIQSSETDHPVLDWLNEQPNESVLY
ISFGSGGCLSAKQLTELAWGLEQSQQRFVWVVRPPVDGSCCSEYVSANGGGTEDNTPEYLPEGFVSRTSDRGFVVPSWAPQAEILSHRA
VGGFLTHCGWSSTLESVVGGVPMIAWPLFAEQNMNAALLSDELGIAVRLDDPKEDISRWKIEALVRKVMTEKEGEAMRRKVKKLRDSAE
MSLSIDGGGLAHESLCRVTKECQRFLERVVDLSRGA

B. *A. thaliana* sucrose transporter SUC1 from (SEQ ID NO: 179)

MGAYETEKPTKDAAALETQSPEDFDQPSPLRKIISVASIAAGVQFGWALQLSLLTPYVQLLGIPHKWSSLIWLCGPVSGMIVQPIVGFH
SDRCRSKFGRRRPFIATGAALVAVAVFLIGYAADFGYKMGDKLEEKVKVRAIGIFALGFWILDVANNTLQGPCRAFLADLAAGDAKRTR
VANAFFSFFMAVGNVLGYAAGSYTNLHKMFPFTMTKACDIYCANLKTCFFLSITLLLIVTVTSLWYVNDKQWSPPPRNADDDEKTSSVP
LFGEIFGAFKVMKRPMWMLLIVTALNWIAWFPFLLFDTDWMGREVFGGDSDGNERSKKLYSLGVQSGAMGLMFNSIVLGFMSLGVEWIG
RKLGGAKRLWGIVNFILAAGLAMTVLVTKFAEDHRKTAGDLAGPSASVKAGALSLFAVLGIPLAITFSTPFALASIFSSCSGAGQGLSL
GVLNLAIVIPQMIVSLGGGPFDALFGGGNLPAFIVAAIAAAISGVLALTVLPSPPPDAPKATTMGGFH

C. *Coffea arabica* sucrose synthase polypeptide (SEQ ID NO: 180)

MAERVLTRVHSLRERLDATLAAHRNEVLLFMSRLETHGKGILKPHQLLAEFEEINKDGKQKINDHAFEEVLKSTQEAIVLPPWVALAIR
LRPGVWEYVRVNVNALVVEELTVPEYLHFKEELVDGSKNGNFVLELDFEPFTASFPRPTLYKYIGDGVEFLNRHLSAKMFHDKESMAPL
LDFLRVHQYKGKTMMLNDRIKDLNTLQAVLRKAEEYLTTLSADTPYSEFEHKFQEIGLERGWGDTAERVLEMICMLLDLLGAPDSCTLE
KFLGRIPMVFNVVILSPHGYFAQENVLGYPDTGGQVVYILDQVPALEREMLKRIKEQGLDVKPRILIITRLLPDAPGTTCGQRLEKVYG
SEYSHILRVPFRTEKGVVRKWISRFEVWPYMETFTEDVAKEVTAELQAKPDLVIGNYSEGNLVASLLAHKLGVTQCTIAHALEKTKYPD
SDIYLSKFDEKYHFSCQFTADLIAMNHTDFIITSTFQEIAGSKDTVGQYESHMAFTMPGLYRVVHGIDVFDPKFNIVSPGADTNLYFPH
TEKEKRLTSFHPEIEELLFSDVENEEHLCVLKDKKKPILFTMARLDRVKNLTGLVELYAKNPKLRELVNLVVVGGDRRKESKDLEEQAE
MKKMYSLIETYNLNGQFRWISSQMNRVRNGELYRYIADTRGAFVQPAFYEAFGLTVVEAMTCGLPTFATNHGGPAEIIIHGKSGFHIDP
YHGEQVAELLANFFERCKKEPSYWDTISAGGLKRIQEKYTWQIYSERLLTLAGVYGFWKCVSKLDRQEIPRYLEMFYALKYRKLAEAVP
LAVDQ

FIGURE 21

SEQ ID NO: 185 (*Saccharomyces cerevisiae* Cyc1 promoter)

gcgttggttggtggatcaagcccacgcgtaggcaatcctcgagcagatccgccaggcgtgtatatatagcgtggatggccaggcaactt
tagtgctgacacatacaggcatatatatatgtgtgcgacgacacatgatcatatggcatgcatgtgctctgtatgtatataaaactctt
gttttcttcttttctctaaatattctttccttatacattaggacctttgcagcataaattactatacttctatagacacacaaacacaa
atacacacactaaattaata SEQ ID NO: 186 (*Saccharomyces cerevisiae* Kex2 promoter)
ggtcagcagctcttgatgtacgatacaacgtatctctcgacatgctttttatttcttactatacatacataaagaaatataaaaaatgataacgtgta
tattattattcacataatcaatgagggtcattttctgaaacgcaaaaaacggtaaatggaaaaaaaataaagatagaaaaagaaaacaa
acaaaggaaaggtagcatattaaataactgagctgatacttcaacagcatcgctgaagagaacagtattgaaaccgaaacattttcta
aaggcaaacaaggtactccatatttgctggacgtgttctttctctcgtttcatatgcataattctgtcataagcctgttcttttttcctg
gcttaaacatcccgttttgtaaaagagaaatctattccacatatttcattcattcggctaccatactaaggataaactaatcccgttgt
tttttggcctcgtcacataattataaactactaaccattatcaga

ORF

SEQ ID NO: 187 #5-CACAAATACACACACTAAATTAATA------------------atg wt 100%
SEQ ID NO: 191 #4-CACAAATACACACACTAAATTAATATGAATTCGTTAACGAAATTatg 75%
SEQ ID NO: 190 #3-CACAAATACACACACTAAATTAATATGAATTCGTTAACGAAGTCatg 50%
SEQ ID NO: 189 #2-CACAAATACACACACTAAATTAATATGAATTCGTTAACGAACTCatg 20%
SEQ ID NO: 188 #1-CACAAATACACACACTAAATTAATATGAATTCGTTAACGAATTCatg 5%

FIGURE 23

>sp|P29704|FDFT_YEAST Squalene synthase OS=*Saccharomyces cerevisiae* (strain ATCC 204508 / S288c) GN=ERG9 PE=1 SV=2 (SEQ ID NO: 192)
MGKLLQLALHPVEMKAALKLKFCRTPLFSIYDQSTSPYLLHCFELLNLTSRSFAAVIREL
HPELRNCVTLFYLILRALDTIEDDMSIEHDLKIDLLRHFHEKLLLTKWSFDGNAPDVKDR
AVLTDFESILIEFHKLKPEYQEVIKEITEKMGNGMADYILDENYNLNGLQTVHDYDVYCH
YVAGLVGDGLTRLIVIAKFANESLYSNEQLYESMGLFLQKTNIIRDYNEDLVDGRSFWPK
EIWSQYAPQLKDFMKPENEQLGLDCINHLVLNALSHVIDVLTYLAGIHEQSTFQFCAIPQ
VMAIATLALVFNNREVLHGNVKIRKGTTCYLILKSRTLRGCVEIFDYYLRDIKSKLAVQD
PNFLKLNIQISKIEQFMEEMYQDKLPPNVKPNETPIFLKVKERSRYDDELVPTQQEEEYK
FNMVLSIILSVLLGFYYIYTLHRA >sp|P36596|FDFT_SCHPO Squalene synthase OS=*Schizosaccharomyces pombe* (strain ATCC 38366 / 972) GN=erg9 PE=1 SV=1 (SEQ ID NO: 193)
MSLANRIEEIPCLCQKLWNDLFDYGEDENVFQKMIERCYQLLDMTSRSFAVVIKELPNGI
REAVMIFYLVLRGLDTVEDDMTLPLDKKLPILRDFYKTIEVEGWTFNESGPNEKDRQLLV
EFDVVIKEYLNLSEGYRNVISNITKEMGDGMAYYASLAEKNDGFSVETIEDFNKYCHYVA
GLVGIGLSRLFAQSKLEDPDLAHSQAISNSLGLFLQKVNIIRDYREDFDDNRHFWPREIW
SKYTSSFGDLCLPDNSEKALECLSDMTANALTHATDALVYLSQLKTQEIFNFCAIPQVMA
IATLAAVFRNPDVFQTNVKIRKGQAVQIILHSVNLKNVCDLFLRYTRDIHYKNTPKDPNF
LKISIECGKIEQVSESLFPRRFREMYEKAYVSKLSEQKKGNGTQKAILNDEQKELYRKDL
QKLGISILFVFFIILVCLAVIFYVFNIRIHWSDFKELNLF >sp|Q9Y753|FDFT_YARLI Squalene synthase OS=*Yarrowia lipolytica* (strain CLIB 122 / E 150) GN=SQS1 PE=3 SV=1 (SEQ ID NO: 194)
MGKLIELLLHPSELSAAIHYKLWRQPLHPRDLSKESTELRRCYELLDVCSRSFAAVIREL
HPEVRDAVMLFYLILRALDTIEDDMTLSRDIKIPILRDFTKCMKTPGWKFTDSDPNERDR
VVLQEFPVVMTEFNKLKPKYQEVIYDITDRMGNGMADYVIDDDFNNNGVDTIAAYDLYCH
HVAGIVGEGLTRITILAGFGTDVLHENPRLQESMGLFLQKVNIIRDYREDIDVNRAFWPR
EIWHKYAEEMRDFKDPKYSKKALHCTSDLVANALGHATDCLDYLDNVTDPSTFTFCAIPQ FIGURE 25 (cont'd)

VNAIATLQLVYKNPDVFQKNVKLRKGTTVSLILEASNVSGVCDIFTRYARKVYKKSDPND
PNYFPVSVLCGRIEQHAALIKRQRQPPAKTIAQLEGERKEMALSLIVCLAVIFGMSGLMA
TIAYVSSFRWSFREIFGSKMFPLRD

>sp|Q9HGZ6|FDFT_CANGA Squalene synthase OS=*Candida glabrata* (strain ATCC 2001 / CBS 138 / JCM 3761 / NBRC 0622 / NRRL Y-65) GN=ERG9 PE=3 SV=2 (SEQ ID NO: 195)
MGKVLDLALHPLELRAALKLKPIRQPLFSENDTRATPQLERCYELLNLTSRSFAAVIMEL
KPELRNVIMVFYLILRALDTVEDDMTIDPQLKVKVLRSFDSKLDTTDWSFDGNDLKEKDR
VVLTEFPCILGEYHRLKPEYQKVIKKITGLMGNGMADYILDENFNLNGVQTVKDYDKYCH
YVAGLVGDGLTELIVLAGFSSDLYHGRNSTQLYESMGLFLQKTNIIRDYAEDLDDGRSF
WPKEIWSEYATKLTDFRDPKNTQKSVDCINHLVLNALTHVIDVLTYLSSIHEQSSFQFCA
IPQVMAIATLAKVFNNPEVLRKNVKIRKGTTCDLILNSRTLRGCVDIFQYYLRDMKQRLP
VEDPNYLKFNIQVAKIEQFIEEMFQDKLPAGVEPRETKIYLKVQERLKNDTQVIPRVQEE
DYKFNMALSVVFCVLLSFYFFTK >sp|Q752X9|FDFT_ASHGO Squalene synthase OS=*Ashbya gossypii* (strain ATCC 10895 / CBS 109.51 / FGSC 9923 / NRRL Y-1056) GN=ERG9 PE=3 SV=1 (SEQ ID NO: 196)
MGKVVQLFTHPLELKAALKLKFLREPLYPADDTQGSAELKRCYQLLQRTSRSFAAVIMEL
HPELRNAVMLFYLILRALDTVEDDMTISPKVKVPLLREFDQKLKLDTWSFDGNAKTEKDR
DVLVEFSTILAEFHKLKPEYQQVIADITHKMGNGMADYILDEKFNLSGLETIQDYDRYCH
YVAGLVGDGLTHLIMLAKFSSPGLYYDSPDLYESMGLFLQKTNIIRDYAEDLADGRSFWP
KEINSKYADDLASFSKPENATAGVYCINHLVLNALGHVQHVLTYLASLREQSSFQFCAIP
QVMAIATLALVFGNERVLQTSVKIRKGTTCYLILKSRTFQGCVEIFEHYLRDIRKRLTVA
DPNYLKLNIEIAKLDKFIEEMYQDKLPVGAKPQETEIYKKVRERSAYDLEVLPREQEEEF
KFNVLLSILFTVFGALYWYAK >sp|O74165|FDFT_CYBJA Squalene synthase OS=*Cyberlindnera jadinii* GN=ERG9 PE=3 SV=1 (SEQ ID NO: 197)
MGKLLQLALHPDELASIVQFKLFRKNENARNPATESAKLIRCYELLNLTSRSFAAVIREL
HPELRNVIMVFYLVLRALDTVEVDMSIENSVKLPVLRQFHEKLDTKDWTFDGNSPNEKDR
CVLVEFDRILGQYHELKPQYQKVIKEITEKMGNGMADYIENENFNSNGLLTIEEYDLYCY FIGURE 25 (cont'd)

YVAGLVGDGLTQLIVLAKFGNSELSVNKQLFRSMGLFLQKTNIIRDYEEDQVDGRAFWPK
EIWSKYANELSDEMMKPENQSQGLWCISELVCNALDHVIDVLCYLALVEQTSFNFCAIPQ
VMAIATLELVFQNPQVLTQRVKIRKGTTVELIIESRTLEGCARIYRAYLRKIHHKSHPSD
PNYLRLGITIGKIDQFLDGMYPHYVPKGITPQTTSIRIQVVKRLQLDEPNFRSIDEEILK
TRCLLLSLGVAVFGVVYGVVRII

>sp|P78589|FDFT_CANAL Squalene synthase OS=Candida albicans GN=ERG9 PE=3 SV=1
(SEQ ID NO: 198)
MGKFLQLLSHPTELKAVIQLFGFRQPLHPGKRDVNDKELSRCYELLNLTSRSFAAVIEEL
HPELRDAVMIFYLVLRALDTIEDDMTIKSSIKIPLLREFDEKLNTKNWTFDGNGPNEKDR
TVLVEFDKILNVYHRLKPQYQDIIKSITFKMGNGMADYILDEEFNVYGVATVEDYNLYCH
YVAGLVGEGLTRLFVLANFGDKTLTENNFAKADSMGLFLQKTNIIRDYHEDLQDGRSFWP
REIWSKYTENLQDFHKVKTPAKEFASVSCINELVLNALRHVTDCLDYLSLVKDPSSFSFC
AIPQVMAVATLAEVYNNPKVLHGVVKIRKGTTCRLILESRTLPGVVKIFKEYIQVINHKS
SVRDPNYLKIGIKCGEIEQYCEMIYPNKQALPPSMKSLPENKFTKIVASRESIDLSVQRR
IEPGNFNCNVVLFGIGALIILSLIYFVLY >sp|P38604|ERG7_YEAST Lanosterol synthase OS=Saccharomyces cerevisiae (strain ATCC 204508
/ S288c) GN=ERG7 PE=1 SV=6 (SEQ ID NO: 199)
MTEFYSDTIGLPKTDPRLWRLRTDELGRESWEYLTPQQAANDPPSTFTQWLLQDPKFPQP
HPERNKHSPDFSAFDACHNGASFFKLLQEPDSGIFPCQYKGPMFMTIGYVAVNYIAGIEI
PEHERIELIRYIVNTAHPVDGGWGLHSVDKSTVFGTVLNYVILRLLGLPKDHPVCAKARS
TLLRLGGAIGSPHWGKIWLSALNLYKWEGVNPAPPETWLLPYSLPMHPGRWWVHTRGVYI
PVSYLSLVKFSCPMTPLLEELRNEIYTKPFDKINFSKNRNTVCGVDLYYPHSTTLNIANS
LVVFYEKYLRNRFIYSLSKKKVYDLIKTELQNTDSLCIAPVNQAFCALVTLIEEGVDSEA
FQRLQYRFKDALFHGPQGMTIMGTNGVQTWDCAFAIQYFFVAGLAERPEFYNTIVSAYKF
LCHAQFDTECVPGSYRDKRKGAWGFSTKTQGYTVADCTAEAIKAIIMVKNSPVFSEVHHM
ISSERLFEGIDVLLNLQNIGSFEYGSFATYEKIKAPLAMETLNPAEVFGNIMVEYPYVEC
TDSSVLGLTYFHKYFDYRKEEIRTRIRIAIEFIKKSQLPDGSWYGSWGICFTYAGMFALE
ALHTVGETYENSSTVRKGCDFLVSKQMKDGGWGESMKSSELHSYVDSEKSLVVQTAWALI
ALLFAEYPNKEVIDRGIDLLKNRQEESGEWKFESVEGVFNHSCAIEYPSYRFLFPIKALGMYSRAYETHTL FIGURE 25 (cont'd)

>sp|P37268|FDFT_HUMAN Squalene synthase OS=*Homo sapiens* GN=FDFT1 PE=1 SV=1
(SEQ ID NO: 200)
MEFVKCLGHPEEFYNLVRFRIGGKRKVMPKMDQDSLSSSLKTCYKYLNQTSRSFAAVIQA
LDGEMRNAVCIFYLVLRALDTLEDDMTISVEKKVPLLHNFHSFLYQPDWRFMESKEKDRQ
VLEDFPTISLEFRNLAEKYQTVIADICRRMGIGMAEFLDKHVTSEQEWDKYCHYVAGLVG
IGLSRLFSASEFEDPLVGEDTERANSMGLFLQKTNIIRDYLEDQQGGREFWPQEVWSRYV
KKLGDFAKPENIDLAVQCLNELITNALHHIPDVITYLSRLRNQSVFNFCAIPQVMAIATL
AACYNNQQVFKGAVKIRKGQAVTLMMDATNMPAVKAIIYQYMEEIYHRIPDSDPSSSKTR
QIISTIRTQNLPNCQLISRSHYSPIYLSFVMLLAALSWQYLTTLSQVTEDYVQTGEH >sp|P53798|FDFT_MOUSE Squalene synthase OS=*Mus musculus* GN=Fdft1 PE=2 SV=2
(SEQ ID NO: 201)
MEFVKCLGHPEEFYNLLRFRMGGRRNFIPKMDQDSLSSSLKTCYKYLNQTSRSFAAVIQA
LDGDIRHAVCVFYLVLRALDTVEDDMSISVEKKIPLLCNFHTFLYDPEWRFTESKEKDRQ
VLEDFPTISLEFRNLAEKYQTVIDDICHRMGCGMAEFVDKDVTSKQDWDKYCHYVAGLVG
IGLSRLFSASEFEDPIVGEDIECANSMGLFLQKTNIIRDYLEDQQEGRKFWPQEVWGRYI
KKLEDFAKPENVDVAVQCLNELITNTLQHIPDVLTYLSRLRNQSVFNFCAIPQVMAIATL
AACYNNQQVFKGVVKIRKGQAVTLMMDATNMPAVKAIIYQYIEEIYHRIPNSDPSSSKTK
QVISKIRTQNLPNCQLISRSHYSPIYLSFIMLLAALSWQYLSTLSQVTEDYVQREH >sp|Q02769|FDFT_RAT Squalene synthase OS=*Rattus norvegicus* GN=Fdft1 PE=2 SV=1
(SEQ ID NO: 202)
MEFVKCLGHPEEFYNLLRFRMGGRRNFIPKMDRNSLSNSLKTCYKYLDQTSRSFAAVIQA
LDGDIRHAVCVFYLILRAMDTVEDDMAISVEKKIPLLRNFHTFLYEPEWRFTESKEKHRV
VLEDFPTISLEFRNLAEKYQTVIADICHRMGCGMAEFLNKDVTSKQDWDKYCHYVAGLVG
IGLSRLFSASEFEDPIVGEDTECANSMGLFLQKTNIIRDYLEDQQEGRQFWPQEVWGKYV
KKLEDFVKPENVDVAVKCLNELITNALQHIPDVITYLSRLRNQSVFNFCAIPQVMAIATL
AACYNNHQVFKGVVKIRKGQAVTLMMDATNMPAVKAIIYQYIEEIYHRVPNSDPSASKAK
QLISNIRTQSLPNCQLISRSHYSPIYLSFIMLLAALSWQYLSTLSQVTEDYVQREH FIGURE 25 (cont'd)

*Aspergillus nidulans* GGPPS-2 polypeptide (SEQ ID NO: 203)

NTSDSHFHPPHAIFFRISSNRMSGASTRCKAALNGNFEKDWLSKGDKLQTNTDLSKRHTR
RQSSLDGTKYKDGKWSQENEEVIMGPYDYMLQHPGKDLRRQMINAFNVWLKVPSESLAII
TKVVAMLHTASLLIDDVEDNSLLRRGIPVAHSIYGTAQTINSANYVYFLALQEVQKLKSP
AAIDIYVQELLNLHRGQGMDLFWRDTLTCPSEDEYLEMVGNKTGGLFRLAVKLMQAESST
GKDCVALVNVLGLVFQICDDYLNLSDTTYTQNKGLCEDLTEGKFSFPIIHSIRSNPGNRQ
LINILPQRTKDEEVKRYALQYMESTGSFKHTQDVVRQLRARALQLIEEIENSENGEQPES
RNDGTMVRAILDKIYESTLADTNTTTRDINGNCATR

*Saccharomyces cerevisiae* GGPPS-3 polypeptide (SEQ ID NO: 167)

MEAKIDELINNDPVWSSQNESLISKPYNHILLKPGKNFRLNLIVQINRVMNLPKDQLAIV
SQIVELLHNSSLLIDDIEDNAPLRRGQTTSHLIFGVPSTINTANYMYFRAMQLVSQLTTK
EPLYHNLITIFNEELINLHRGQGLDIYWRDFLPEIIPTQEMYLNMVMNKTGGLFRLTLRL
MEALSPSSHHGHSLVPFINLLGIIYQIRDDYLNLKDFQMSSEKGFAEDITEGKLSFPIVH
ALNFTKTKGQTEQHNEILRILLLRTSDKDIKLKLIQILEFDTNSLAYTKNFINQLVNMIK
NDNENKYLPDLASHSDTATNLHDELLYIIDHLSEL

RECOMBINANT PRODUCTION OF STEVIOL GLYCOSIDES

CROSS-REFERENCE TO RELATED APPLICATIONS

This application claims priority to U.S. Application Ser. No. 61/521,084, filed Aug. 8, 2011; U.S. Application Ser. No. 61/521,203, filed Aug. 8, 2011; U.S. Application Ser. No. 61/521,051, filed Aug. 8, 2011; U.S. Application Ser. No. 61/523,487, filed Aug. 15, 2011; U.S. Application Ser. No. 61/567,929, filed Dec. 7, 2011; and U.S. Application Ser. No. 61/603,639, filed Feb. 27, 2012, all of which are incorporated by reference herein in their entirety.

TECHNICAL FIELD

This disclosure relates to the recombinant production of steviol glycosides. In particular, this disclosure relates to the production of steviol glycosides such as rebaudioside D by recombinant hosts such as recombinant microorganisms, plants, or plant cells. This disclosure also provides compositions containing steviol glycosides. The disclosure also relates to tools and methods for producing terpenoids by modulating the biosynthesis of terpenoid precursors of the squalene pathway.

BACKGROUND

Sweeteners are well known as ingredients used most commonly in the food, beverage, or confectionary industries. The sweetener can either be incorporated into a final food product during production or for stand-alone use, when appropriately diluted, as a tabletop sweetener or an at-home replacement for sugars in baking Sweeteners include natural sweeteners such as sucrose, high fructose corn syrup, molasses, maple syrup, and honey and artificial sweeteners such as aspartame, saccharine and sucralose. *Stevia* extract is a natural sweetener that can be isolated and extracted from a perennial shrub, *Stevia rebaudiana. Stevia* is commonly grown in South America and Asia for commercial production of *stevia* extract. *Stevia* extract, purified to various degrees, is used commercially as a high intensity sweetener in foods and in blends or alone as a tabletop sweetener.

Extracts of the *Stevia* plant contain rebaudiosides and other steviol glycosides that contribute to the sweet flavor, although the amount of each glycoside often varies among different production batches. Existing commercial products are predominantly rebaudioside A with lesser amounts of other glycosides such as rebaudioside C, D, and F. *Stevia* extracts may also contain contaminants such as plant-derived compounds that contribute to off-flavors. These off-flavors can be more or less problematic depending on the food system or application of choice. Potential contaminants include pigments, lipids, proteins, phenolics, saccharides, spathulenol and other sesquiterpenes, labdane diterpenes, monoterpenes, decanoic acid, 8,11,14-eicosatrienoic acid, 2-methyloctadecane, pentacosane, octacosane, tetracosane, octadecanol, stigmasterol, β-sitosterol, α- and β-amyrin, lupeol, β-amryin acetate, pentacyclic triterpenes, centaure-din, quercitin, epi-alpha-cadinol, carophyllenes and derivatives, beta-pinene, beta-sitosterol, and gibberellin.

SUMMARY

Provided herein is a recombinant host, such as a microorganism, plant, or plant cell, comprising one or more biosynthesis genes whose expression results in production of steviol glycosides such as rebaudioside A, rebaudioside C, rebaudioside D, rebaudioside E, rebaudioside F, or dulcoside A. In particular, EUGT11, a uridine 5'-diphospho (UDP) glycosyl transferase described herein, can be used alone or in combination with one or more other UDP glycosyl transferases such as UGT74G1, UGT76G1, UGT85C2, and UGT91D2e, to allow the production and accumulation of rebaudioside D in recombinant hosts or using in vitro systems. As described herein, EUGT11 has a strong 1,2-19-O-glucose glycosylation activity, which is an important step for rebaudioside D production.

Typically, stevioside and rebaudioside A are the primary compounds in commercially-produced *stevia* extracts. Stevioside is reported to have a more bitter and less sweet taste than rebaudioside A. The composition of *stevia* extract can vary from lot to lot depending on the soil and climate in which the plants are grown. Depending upon the sourced plant, the climate conditions, and the extraction process, the amount of rebaudioside A in commercial preparations is reported to vary from 20 to 97% of the total steviol glycoside content. Other steviol glycosides are present in varying amounts in *stevia* extracts. For example, Rebaudioside B is typically present at less than 1-2%, whereas Rebaudioside C can be present at levels as high as 7-15%. Rebaudioside D is typically present in levels of 2% or less, and Rebaudioside F is typically present in compositions at 3.5% or less of the total steviol glycosides. The amount of the minor steviol glycosides affects the flavor profile of a *Stevia* extract. In addition, Rebaudioside D and other higher glycosylated steviol glycosides are thought to be higher quality sweeteners than Rebaudioside A. As such, the recombinant hosts and methods described herein are particularly useful for producing steviol glycoside compositions having an increased amount of Rebaudioside D for use, for example, as a non-caloric sweetener with functional and sensory properties superior to those of many high-potency sweeteners.

In one aspect, this document features a recombinant host that includes a recombinant gene encoding a polypeptide having at least 80% identity to the amino acid sequence set forth in SEQ ID NO:152.

This document also features a recombinant host that includes a recombinant gene encoding a polypeptide having the ability to transfer a second sugar moiety to the C-2' of a 19-O-glucose of rubusoside. This document also features a recombinant host that includes a recombinant gene encoding a polypeptide having the ability to transfer a second sugar moiety to the C-2' of a 19-O-glucose of stevioside.

In another aspect, this document features a recombinant host that includes a recombinant gene encoding a polypeptide having the ability to transfer a second sugar moiety to the C-2' of the 19-O-glucose of rubusoside and to the C-2' of the 13-O-glucose of rubusoside.

This document also features a recombinant host that includes a recombinant gene encoding a polypeptide having the ability to transfer a second sugar moiety to the C-2' of a 19-O-glucose of rebaudioside A to produce rebaudioside D, wherein the catalysis rate of the polypeptide is at least 20 times faster (e.g., 25 or 30 times faster) than a 91D2e polypeptide having the amino acid sequence set forth in SEQ ID NO: 5 when the reactions are performed under corresponding conditions.

In any of the recombinant hosts described herein, the polypeptide can have at least 85% sequence identity (e.g., 90%, 95%, 98%, or 99% sequence identity) to the amino acid sequence set forth in SEQ ID NO:152. The polypeptide can have the amino acid sequence set forth in SEQ ID NO: 152.

Any of the hosts described herein further can include a recombinant gene encoding a UGT85C polypeptide having at least 90% identity to the amino acid sequence set forth in SEQ ID NO:3. The UGT85C polypeptide can include one or more amino acid substitutions at residues 9, 10, 13, 15, 21, 27, 60, 65, 71, 87, 91, 220, 243, 270, 289, 298, 334, 336, 350, 368, 389, 394, 397, 418, 420, 440, 441, 444, and 471 of SEQ ID NO:3.

Any of the hosts described herein further can include a recombinant gene encoding a UGT76G polypeptide having at least 90% identity to the amino acid sequence set forth in SEQ ID NO:7. The UGT76G polypeptide can have one or more amino acid substitutions at residues 29, 74, 87, 91, 116, 123, 125, 126, 130, 145, 192, 193, 194, 196, 198, 199, 200, 203, 204, 205, 206, 207, 208, 266, 273, 274, 284, 285, 291, 330, 331, and 346 of SEQ ID NO:7.

Any of the hosts described herein further can include a gene (e.g., a recombinant gene) encoding a UGT74G1 polypeptide.

Any of the hosts described herein further can include a gene (e.g., a recombinant gene) encoding a functional UGT91D2 polypeptide. The UGT91D2 polypeptide can have at least 80% sequence identity to the amino acid sequence set forth in SEQ ID NO:5. The UGT91D2 polypeptide can have a mutation at position 206, 207, or 343 of SEQ ID NO:5. The UGT91D2 polypeptide also can have a mutation at positions 211 and 286 of SEQ ID NO:5 (e.g., L211M and V286A, referred to as UGT91D2e-b). The UGT91D2 polypeptide can have the amino acid sequence set forth in SEQ ID NOs: 5, 10, 12, 76, 78, or 95.

Any of the hosts described herein further can include one or more of (i) a gene encoding a geranylgeranyl diphosphate synthase;

(ii) a gene encoding a bifunctional copalyl diphosphate synthase and kaurene synthase, or a gene encoding a copalyl diphosphate synthase and a gene encoding a kaurene synthase;

(iii) a gene encoding a kaurene oxidase; and (iv) a gene encoding a steviol synthetase. Each of the genes of (i), (ii), (iii), and (iv) can be a recombinant gene.

Any of the hosts described herein further can include one or more of (v) a gene encoding a truncated HMG-CoA;

(vi) a gene encoding a CPR;

(vii) a gene encoding a rhamnose synthetase;

(viii) a gene encoding a UDP-glucose dehydrogenase; and (ix) a gene encoding a UDP-glucuronic acid decarboxylase. At least one of the genes of (i), (ii), (iii), (iv), (v), (vi), (vii), (viii), or (ix) can be a recombinant gene.

The geranylgeranyl diphosphate synthase can have greater than 90% sequence identity to one of the amino acid sequences set forth in SEQ ID NOs: 121-128. The copalyl diphosphate synthase can have greater than 90% sequence identity to the amino acid sequence set forth in SEQ ID NOs: 129-131. The kaurene synthase can have greater than 90% sequence identity to one of the amino acid sequences set forth in SEQ ID NOs: 132-135. The kaurene oxidase can have greater than 90% sequence identity to one of the amino acid sequences set forth in SEQ ID NOs: 138-141. The steviol synthetase can have greater than 90% sequence identity to one of the amino acid sequences set forth in SEQ ID NOs: 142-146.

Any of the recombinant hosts can produce at least one steviol glycoside when cultured under conditions in which each of the genes is expressed. The steviol glycoside can be selected from the group consisting of rubusoside, rebaudioside A, rebaudioside B, rebaudioside C, rebaudioside D, rebaudioside E, rebaudioside F, dulcoside A, stevioside, steviol-19-O-Glucoside, steviol-13-O-glucoside, steviol-1,2-bioside, steviol-1,3-bioside, 1,3-stevioside, as well as other rhamnosylated or xylosylated intermediates. The steviol glycoside (e.g., rebaudioside D) can accumulate to at least 1 mg/liter (e.g., at least 10 mg/liter, 20 mg/liter, 100 mg/liter, 200 mg/liter, 300 mg/liter, 400 mg/liter, 500 mg/liter, 600 mg/liter, or 700 mg/liter, or greater) of culture medium when cultured under said conditions.

This document also features a method of producing a steviol glycoside. The method includes growing any of the hosts described herein in a culture medium, under conditions in which the genes are expressed; and recovering the steviol glycoside produced by the host. The growing step can include inducing expression of one or more of the genes. The steviol glycoside can be a 13-O-1,2-diglycosylated and/or a 19-O-1,2-diglycosylated steviol glycoside (e.g., stevioside, steviol 1,2 bioside, rebaudioside D, or rebaudioside E). For example, the steviol glycoside can be rebaudioside D or rebaudioside E. Other examples of steviol glycosides can include rebaudioside A, rebaudioside B, rebaudioside C, rebaudioside F, and dulcoside A.

This document also features a recombinant host. The host includes (i) a gene encoding a UGT74G1; (ii) a gene encoding a UGT85C2; (iii) a gene encoding a UGT76G1; (iv) a gene encoding a glycosyltransferase having the ability to transfer a second sugar moiety to the C-2' of a 19-O-glucose of rubusoside or stevioside; and (v) optionally a gene encoding a UGT91D2e, wherein at least one of the genes is a recombinant gene. In some embodiments, each of the genes is a recombinant gene. The host can produce at least one steviol glycoside (e.g., rebaudioside D) when cultured under conditions in which each of the genes (e.g., recombinant genes) is expressed. The host further can include (a) a gene encoding a bifunctional copalyl diphosphate synthase and kaurene synthase, or a gene encoding a copalyl diphosphate synthase and a gene encoding a kaurene synthase; (b) a gene encoding a kaurene oxidase; (c) a gene encoding a steviol synthetase; (d) a gene encoding a geranylgeranyl diphosphate synthase.

This document also features a steviol glycoside composition produced by any of the hosts described herein. The composition has reduced levels of *stevia* plant-derived contaminants relative to a *stevia* extract.

In another aspect, this document features a steviol glycoside composition produced by any of the hosts described herein. The composition has a steviol glycoside composition enriched for rebaudioside D relative to the steviol glycoside composition of a wild-type *Stevia* plant.

In yet another aspect, this document features a method of producing a steviol glycoside composition. The method includes growing a host described herein in a culture medium, under conditions in which each of the genes is expressed; and recovering the steviol glycoside composition produced by the host (e.g., a microorganism). The composition is enriched for rebaudioside A, rebaudioside B, rebaudioside C, rebaudioside D, rebaudioside E, rebaudioside F or dulcoside A relative to the steviol glycoside composition of a wild-type *Stevia* plant. The steviol glycoside composition produced by the host (e.g., microorganism) can have a reduced level of *stevia* plant-derived contaminants relative to a *stevia* extract.

This document also features a method for transferring a second sugar moiety to the C-2' of a 19-O-glucose or the C-2' of a 13-O-glucose in a steviol glycoside. The method includes contacting the steviol glycoside with a EUGT11 polypeptide described herein or UGT91D2 polypeptide described herein (e.g., UGT91D2e-b) and a UDP-sugar under suitable reaction conditions for the transfer of the second sugar moiety to the steviol glycoside. The steviol glycoside can be rubusoside, wherein the second sugar moiety is glucose, and stevioside is produced upon transfer of the second glucose moiety. The steviol glycoside can be stevioside, wherein the second sugar moiety is glucose, and Rebaudioside E is produced upon transfer of the second glucose moiety. The steviol glycoside can be Rebaudioside A, and Rebaudioside D is produced upon transfer of the second glucose moiety.

In another embodiment of an improved downstream steviol glycoside pathway as disclosed herein, materials and methods are provided for the recombinant production of sucrose synthase, and to materials and methods for increasing production of UDP-glucose in a host, specifically for increasing the availability of UDP-glucose in vivo, with the purpose of promoting glycosylation reactions in the cells, and methods for reducing UDP concentrations in the cells are provided.

The document also provides a recombinant host comprising one or more exogenous nucleic acids encoding a sucrose transporter and a sucrose synthase, wherein expression of the one or more exogenous nucleic acids with a glucosyltransferase results in increased levels of UDP-glucose in the host. Optionally, the one or more exogenous nucleic acids comprise a SUS1 sequence. Optionally, the SUS1 sequence is from *Coffea arabica*, or encodes a functional homolog of the sucrose synthase encoded by the *Coffea arabica* SUS1 sequence, but equally an *Arabidopsis thaliana* or *Stevia rebaudiana* SUS may be used as described herein. In the recombinant host of the invention, the one or more exogenous nucleic acids may comprise a sequence encoding a polypeptide having the sequence set forth in SEQ ID NO:180, or an amino acid sequence at least 90 percent identical thereto, and optionally the one or more exogenous nucleic acids comprise a SUC1 sequence. In one embodiment, the SUC1 sequence is from *Arabidopsis thaliana*, or the SUC1 sequence encodes a functional homolog of the sucrose transporter encoded by the *Arabidopsis thaliana* SUC1 sequence. In the recombinant host, the one or more exogenous nucleic acids may comprise a sequence encoding a polypeptide having the sequence set forth in SEQ ID NO:179, or an amino acid sequence at least 90 percent identical thereto. The recombinant host has reduced ability to degrade external sucrose, as compared to a corresponding host that lacks the one or more exogenous nucleic acids.

The recombinant host may be a microorganism, such as a Saccharomycete, for example *Saccharomyces cerevisiae*. Alternatively, the microorganism is *Escherichia coli*. In an alternative embodiment, the recominbant host is a plant or plant cell.

The invention also provides a method for increasing the level of UDP-glucose and reducing the level of UDP in a cell, the method comprising expressing in the cell a recombinant sucrose synthase sequence and a recombinant sucrose transporter sequence, in a medium comprising sucrose, wherein the cell is deficient in sucrose degradation.

The invention additionally provides a method for promoting a glycosylation reaction in a cell, comprising expressing in the cell a recombinant sucrose synthase sequence and a recombinant sucrose transporter sequence, in a medium comprising sucrose, wherein the expressing results in a decreased level of UDP in the cell and an increased level of UDP-glucose in the cell, such that glycosylation in the cell is increased.

In either method for increasing the level of UDP-glucose or promoting glycosylation, the cell may produce vanillin glucoside, resulting in increased production of vanillin glucoside by the cell, or may produce steviol glucoside, resulting in increased production of steviol glucoside by the cell. Optionally, the SUS1 sequence is a *A. thaliana, S. rebaudiana*, or *Coffea arabica* SUS1 sequence (see e.g., FIG. 17, SEQ ID NOs. 175-177), or is a sequence that encodes a functional homolog of the sucrose synthase encoded by the *A. thaliana, S. rebaudiana*, or *Coffea arabica* SUS1 sequence. The recombinant sucrose synthase sequence optionally comprises a nucleic acid encoding a polypeptide having the sequence set forth in SEQ ID NO:180, or an amino acid sequence at least 90% identical thereto, wherein optionally the recombinant sucrose transporter sequence is a SUC1 sequence, or wherein optionally the SUC1 sequence is an *Arabidopsis thaliana* SUC1 sequence, or is a sequence that encodes a functional homolog of the sucrose transporter encoded by the *Arabidopsis thaliana* SUC1 sequence, or wherein optionally the recombinant sucrose transporter sequence comprises a nucleic acid encoding a polypeptide having the sequence set forth in SEQ ID NO:179, or an amino acid sequence at least 90% identical thereto. In either method, the host is a microorganism, for example a Saccharomycete, optionally such as *Saccharomyces cerevisiae*. Or the host may be *Escherichia coli*. Or the host may be a plant cell.

Also provided herein is a recombinant host, such as a microorganism, comprising one or more biosynthesis genes whose expression results in production of diterpenoids. Such genes include a gene encoding an ent-copalyl diphosphate synthase (CDPS) (EC 5.5.1.13), a gene encoding an ent-kaurene synthase, a gene encoding an ent-kaurene oxidase; or a gene encoding a steviol synthetase. At least one of the genes is a recombinant gene. The host can also be a plant cell. Expression of these gene(s) in a *Stevia* plant can result in increased steviol glycoside levels in the plant. In some embodiments the recombinant host further comprises a plurality of copies of a recombinant gene encoding a CDPS polypeptide (EC 5.5.1.13) lacking a chloroplast transit peptide sequence. The CDPS polypeptide can have at least 90%, 95%, 99%, or 100% identity to the truncated CDPS amino acid sequence set forth in FIG. 14. The host can further comprise a plurality of copies of a recombinant gene encoding a KAH polypeptide, e.g., a KAH polypeptide that has at least 90%, 95%, 99%, or 100% identity to the KAH amino acid sequence set forth in FIG. 12. The host can further comprise one or more of: (i) a gene encoding a geranylgeranyl diphosphate synthase; (ii) a gene encoding a ent-kaurene oxidase; and (iii) a gene encoding a ent-kaurene synthase. The host can further comprise one or more of (iv) a gene encoding a truncated HMG-CoA; (v) a gene encoding a CPR; (vi) a gene encoding a rhamnose synthetase; (vii) a gene encoding a UDP-glucose dehydrogenase; and (viii) a gene encoding a UDP-glucuronic acid decarboxylase. Two or more exogenous CPRs can be present, for example. The expression of one or more of such genes can be inducible. At least one of genes (i), (ii), (iii), (iv), (v), (vi), (vii), or (viii) can be a recombinant gene, and in some cases each of the genes of (i), (ii), (iii), (iv), (v), (vi), (vii), and (viii) is a recombinant gene. The geranylgeranyl diphosphate synthase can have greater than 90% sequence identity to the amino acid sequence set forth in SEQ ID NO:127; the kaurene oxidase can have greater than 90% sequence identity to the amino acid sequence set forth in SEQ ID NO:138; a CPR can have greater than 90% sequence identity to the amino acid sequence set forth in SEQ ID NO:168; a CPR can have greater than 90% sequence identity to the amino acid sequence set forth in SEQ ID NO:170, and a kaurene synthase can have greater than 90% sequence identity to the amino acid sequence set forth in SEQ ID NO: 156.

In one aspect, this document features an isolated nucleic acid encoding a polypeptide having the amino acid sequence set forth in SEQ ID NO:5, wherein the polypeptide contains substitutions position 211 and 286 of SEQ ID NO:5. For example, the polypeptide can include a methionine at position 211 and an alanine at position 286.

In one aspect, this document features an isolated nucleic acid encoding a polypeptide having at least 80% identity (e.g., at least 85%, 90%, 95%, or 99% identity) to the amino acid sequence set forth in FIG. 12C (SEQ ID NO:164). The polypeptide can have the amino acid sequence set forth in FIG. 12C.

In another aspect, this document features a nucleic acid construct that included a regulatory region operably linked to a nucleic acid encoding a polypeptide having at least 80% identity (e.g., at least 85%, 90%, 95%, or 99% identity) to the amino acid sequence set forth in FIG. 12C (SEQ ID NO:164). The polypeptide can have the amino acid sequence set forth in FIG. 12C.

This document also features a recombinant host that includes a recombinant gene (e.g., a plurality of copies of a recombinant gene) encoding a KAH polypeptide having at least 80% identity (e.g., at least 85%, 90%, 95%, or 99% identity) to the amino acid sequence set forth in FIG. 12C. The polypeptide can have the amino acid sequence set forth in FIG. 12C. The host can be a microorganism such as a saccharomycete (e.g., *Saccharomyces cerevisiae*) or *Escherichia coli*. The host can be a plant or plant cell (e.g., a *Stevia, Physcomitrella*, or tobacco plant or plant cell). The *Stevia* plant or plant cell is a *Stevia rebaudiana* plant or plant cell. The recombinant host can produce steviol when cultured under conditions in which each of the genes is expressed. The recombinant host can further comprise a gene encoding a UGT74G1 polypeptide; a gene encoding a UGT85C2 polypeptide; a gene encoding a UGT76G1 polypeptide; a gene encoding a UGT91D2 polypeptide; and/or a gene encoding a EUGT11 polypeptide. Such a host can produce at least one steviol glycoside when cultured under conditions in which each of the genes is expressed. The steviol glycoside can be steviol-13-O-glucoside, steviol-19-O-glucoside, rubusoside, rebaudioside A, rebaudioside B, rebaudioside C, rebaudioside D, rebaudioside E, rebaudioside F, and/or dulcoside A. The recombinant host can further comprise one or more of: a gene encoding a deoxyxylulose 5-phosphate synthase (DXS); a gene encoding a D-1-deoxyxylulose 5-phosphate reductoisomerase (DXR); a gene encoding a 4-diphosphocytidyl-2-C-methyl-D-erythritol synthase (CMS); a gene encoding a 4-diphosphocytidyl-2-C-methyl-D-erythritol kinase (CMK); a gene encoding a 4-diphosphocytidyl-2-C-methyl-D-erythritol 2,4-cyclodiphosphate synthase (MCS); a gene encoding a 1-hydroxy-2-methyl-2(E)-butenyl 4-diphosphate synthase (HDS); and a gene encoding a 1-hydroxy-2-methyl-2(E)-butenyl 4-diphosphate reductase (HDR). The recombinant host can further comprise one or more of: a gene encoding an acetoacetyl-CoA thiolase; a gene encoding a truncated HMG-CoA reductase; a gene encoding a mevalonate kinase; a gene encoding a phosphomevalonate kinase; and a gene encoding a mevalonate pyrophosphate decarboxylase. In another aspect, this document features a recombinant host that further comprises a gene encoding an ent-kaurene synthase (EC 4.2.3.19) and/or a gene encoding a gibberellin 20-oxidase (EC 1.14.11.12). Such a host produces gibberellin GA3 when cultured under conditions in which each of the genes is expressed.

This document also features an isolated nucleic acid encoding a CPR polypeptide having at least 80% sequence identity (e.g., at least 85%, 90%, 95%, or 99% sequence identity) to the *S. rebaudiana* CPR amino acid sequence set forth in FIG. 13. In some embodiments, the polypeptide has the *S. rebaudiana* CPR amino acid sequence set forth in FIG. 13 (SEQ ID NOs: 169 and 170).

In any of the hosts described herein, expression of one or more of the genes can be inducible.

In any of the hosts described herein, one or more genes encoding endogenous phosphatases can be deleted or disrupted such that endogenous phosphatase activity is reduced. For example, the yeast gene DPP1 and/or LPP1 can be disrupted or deleted such that the degradation of farnesyl pyrophosphate (FPP) to farnesol is reduced and the degradation of geranylgeranylpyrophosphate (GGPP)) to geranylgeraniol (GGOH) is reduced.

In another aspect, as described herein, ERGS can be modified as defined below, resulting in the decreased production of squalene synthase (SQS) and an accumulation of terpenoid precursors. The precursors may or may not be secreted into the culture medium and can in turn be used as substrates to enzymes capable of metabolizing the terpenoid precursors into desired terpenoids.

Thus, in a main aspect the present invention relates to a cell comprising a nucleic acid sequence, said nucleic acid comprising i) a promoter sequence operably linked to ii) a heterologous insert sequence operably linked to iii) an open reading frame operably linked to iv) a transcription termination signal, wherein the heterologous insert sequence has the general formula (I):

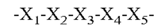

$-X_1-X_2-X_3-X_4-X_5-$ wherein $X_2$ comprises at least 4 consecutive nucleotides being complementary to, and forming a hairpin secondary structure element with at least 4 consecutive nucleotides of $X_4$, and wherein $X_3$ is optional and if present comprises unpaired nucleotidesinvolved in forming a hairpin loop between $X_2$ and $X_4$, and wherein $X_1$ and $X_5$ individually and optionally comprises one or more nucleotides, and wherein the open reading frame upon expression encodes a polypeptide sequence having at least 70% identity to a squalene synthase (EC 2.5.1.21) or a biologically active fragment thereof, said fragment having at least 70% sequence identity to said squalene synthase in a range of overlap of at least 100 amino acids.

The cell of the present invention is useful in enhancing yield of industrially interesting terpenoids. Accordingly, in another aspect the present invention relates to a method for producing a terpenoid compound synthesized through the squalene pathway, in a cell culture, said method comprising the steps of (a) providing the cell as defined herein above, (b) culturing the cell of (a).

(c) recovering the terpenoid product compound.

By providing the cell comprising the genetically modified construct defined herein above, the accumulation of terpenoid precursors is enhanced (see e.g., FIG. 20).

Thus, in another aspect, the invention relates to a method for producing a terpenoid derived from a terpenoid precursor selected from the group consisting of Farnesyl-pyrophosphate (FPP), Isopentenyl-pyrophosphate (IPP), Dimethylallyl-pyrophosphate (DMAPP), Geranyl-pyrophosphate (GPP) and/or Geranylgeranyl-pyrophosphate (GGPP), said method comprising:

(a) contacting said precursor with an enzyme of the squalene synthase pathway, (b) recovering the terpenoid product.

The present invention may operate by at least partly, sterically hindering binding of the ribosome to the RNA thus reducing the translation of squalene synthase. Accordingly, in one aspect the present invention relates to a method for reducing the translation rate of a functional squalene synthase (EC 2.5.1.21) said method comprising:

(a) providing the cell defined herein above, (b) culturing the cell of (a).

Similarly, the invention in another aspect relates to a method for decreasing turnover of farnesyl-pp to squalene, said method comprising:

(a) providing the cell defined herein above, (b) culturing the cell of (a).

As depicted in FIG. 20, the knocking down of the ERG9 results in build-up of precursors to squalene synthase. Thus in one aspect, the present invention relates to a method for enhancing accumulation of a compound selected from the group consisting of Farnesyl-pyrophosphate, Isopentenyl-pyrophosphate, Dimethylallyl-pyrophosphate, Geranyl-pyrophosphate and Geranylgeranyl-pyrophosphate, said method comprising the steps of:

(a) providing the cell defined herein above, and (b) culturing the cell of (a).

In one embodiment the invention relates to the production of Geranylgeranyl Pyrophosphate (GGPP) as well as other terpenoids, which can be prepared from Geranylgeranyl Pyrophosphate (GGPP).

In this embodiment of the invention the above described decrease of production of squalene synthase (SQS) may be combined with an increase in activity of Geranylgeranyl Pyrophosphate Synthase (GGPPS), which converts FPP to Geranylgeranyl Pyrophosphate (GGPP), leading to increased production of GGPP.

Thus, in one embodiment the invention relates to a microbial cell comprising a nucleic acid sequence, said nucleic acid comprising i) a promoter sequence operably linked to ii) a heterologous insert sequence operably linked to iii) an open reading frame operably linked to iv) a transcription termination signal, wherein the heterologous insert sequence and the open reading frame are as defined herein above, wherein said microbial cell furthermore comprises a heterologous nucleic acid encoding GGPPS operably linked to a nucleic acid sequence directing expression of GGPPS in said cell.

In addition, the document relates to a method for producing steviol or a steviol glycoside, wherein the method comprises use of any one of the above-mentioned microbial cells.

Any of the hosts described herein can be a microorganism (e.g., a Saccharomycete such as *Saccharomyces cerevisiae*, or *Escherichia coli*), or a plant or plant cell (e.g., a *Stevia* such as a *Stevia rebaudiana, Physcomitrella*, or tobacco plant or plant cell).

Unless otherwise defined, all technical and scientific terms used herein have the same meaning as commonly understood by one of ordinary skill in the art to which the invention belongs. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and are not intended to be limiting. Other features and advantages of the invention will be apparent from the following detailed description. Applicants reserve the right to alternatively claim any disclosed invention using the transitional phrase “comprising,” “consisting essentially of,” or “consisting of,” according to standard practice in patent law.

DESCRIPTION OF DRAWINGS

FIG. 6 is an alignment of the amino acid sequence of EUGT11 (SEQ ID NO:152, top line) with the amino acid sequence of UGT91D2e (SEQ ID NO:5, bottom line).

FIG. 7 contains the amino acid sequence of EUGT11 (SEQ ID NO:152), the nucleotide sequence (SEQ ID NO:153) encoding EUGT11, and the nucleotide sequence encoding EUGT11 that has been codon optimized for expression in yeast (SEQ ID NO: 154).

FIG. 9 is an alignment of the amino acid sequences of UGT91D1 and UGT91D2e (SEQ ID NO: 5).

FIG. 12A is the nucleotide sequence encoding the *Stevia rebaudiana* KAH (SEQ ID NO:163), designated SrKAHe1 herein.

FIG. 12B is the nucleotide sequence encoding the *Stevia rebaudiana* KAHe1 that has been codon-optimized for expression in yeast (SEQ ID NO:165).

FIG. 12C is the amino acid sequence of the *Stevia rebaudiana* KAHe1 (SEQ ID NO:164).

FIG. 13A contains the amino acid sequences of CPR polypeptides from *S. cerevisiae* (encoded by NCP1 gene) (SEQ ID NO:166), *A. thaliana* (encoded by ATR1 and encoded by ATR2) ((SEQ ID NOs: 148 and 168), and *S. rebaudiana* (encoded by CPR7 and encoded by CPR8) (SEQ ID NOs: 169 and 170).

FIG. 13B contains ATR1 nucleotide sequence (Accession No. CAA23011) that has been codon optimized for expression in yeast (SEQ ID NO:171); ATR2 nucleotide sequence that has been codon optimized for expression in yeast (SEQ ID NO:172); the *Stevia rebaudiana* CPR7 nucleotide sequence (SEQ ID NO:173); and the *Stevia rebaudiana* CPR8 nucleotide sequence (SEQ ID NO:174).

FIG. 14A contains the nucleotide sequence (SEQ ID NO:157) encoding a CDPS polypeptide (SEQ ID NO:158) from *Zea mays*. The sequence that is in bold and underlined can be deleted to remove the sequence encoding the chloroplast transit sequence.

FIG. 14B contains the amino acid sequence of the CDPS polypeptide (SEQ ID NO:158) from *Zea mays*. The sequence that is in bold and underlined can be deleted to remove the chloroplast transit sequence.

FIG. 15A contains a codon-optimized nucleotide sequence (SEQ ID NO:161) encoding a bifunctional CDPS-KS polypeptide (SEQ ID NO:162) from *Gibberella fujikuroi*. FIG. 15B contains the amino acid sequence of the bifunctional CDPS-KS polypeptide (SEQ ID NO:162) from *Gibberella fujikuroi*.

FIG. 17 contains the nucleic acid sequences encoding the *A. thaliana, S. rebaudiana* (from contig10573 selection_ORF S11E, with the mutation that changes S11 to glutamate (E) in bold, lowercase letters), and coffee (*Coffea arabica*) sucrose synthases, SEQ ID NOs:175, 176, and 177, respectively.

FIG. 19A is the amino acid sequence of the *A. thaliana* UDP-glycosyltransferase UGT72E2 (SEQ ID NO:178).

FIG. 19B is the amino acid sequence of the sucrose transporter SUC1 from *A. thaliana* (SEQ ID NO:179).

FIG. 19C is the amino acid sequence of the sucrose synthase from coffee (SEQ ID NO:180).

FIG. 21 contains the nucleotide sequence of the *Saccharomyces cerevisiae* Cyc1 promoter (SEQ ID NO:185) and *Saccharomyces cerevisiae* Kex2 promoter (SEQ ID NO:186).

FIG. 25 contains the amino acid sequence of squalene synthase polypeptides from *Saccharomyces cerevisiae, Schizosaccharomyces pombe, Yarrowia lipolytica, Candida glabrata, Ashbya gossypii, Cyberlindnera jadinii, Candida albicans, Saccharomyces cerevisiae, Homo sapiens, Mus musculus*, and *Rattus norvegicus* (SEQ ID NOs:192-202), and the amino acid sequence of a geranylgeranyl diphosphate synthase (GGPPS) from *Aspergilus nidulans* and *S. cerevisiae* (SEQ ID NOs. 203 and 167).

Like reference symbols in the various drawings indicate like elements.

DETAILED DESCRIPTION

This document is based on the discovery that recombinant hosts such as plant cells, plants, or microorganisms can be developed that express polypeptides useful for the biosynthesis of steviol glycosides such as rebaudioside A, rebaudioside C, rebaudioside D, rebaudioside E, rebaudioside F, or dulcoside A. The recombinant hosts described herein are particularly useful for producing Rebaudioside D. Such hosts can express one or more Uridine 5'-diphospho (UDP) glycosyl transferases suitable for producing steviol glycosides. Expression of these biosynthetic polypeptides in various microbial chassis allows steviol glycosides to be produced in a consistent, reproducible manner from energy and carbon sources such as sugars, glycerol, $CO_2$, $H_2$, and sunlight. The proportion of each steviol glycoside produced by a recombinant host can be tailored by incorporating preselected biosynthetic enzymes into the hosts and expressing them at appropriate levels, to produce a sweetener composition with a consistent taste profile. Furthermore, the concentrations of steviol glycosides produced by recombinant hosts are expected to be higher than the levels of steviol glycosides produced in the *Stevia* plant, which improves the efficiency of the downstream purification. Such sweetener compositions contain little or no plant based contaminants, relative to the amount of contaminants present in *Stevia* extracts.

At least one of the genes is a recombinant gene, the particular recombinant gene(s) depending on the species or strain selected for use. Additional genes or biosynthetic modules can be included in order to increase steviol glycoside yield, improve efficiency with which energy and carbon sources are converted to steviol and its glycosides, and/or to enhance productivity from the cell culture or plant. Such additional biosynthetic modules include genes involved in the synthesis of the terpenoid precursors, isopentenyl diphosphate and dimethylallyl diphosphate. Additional biosynthetic modules include terpene synthase and terpene cyclase genes, such as genes encoding geranylgeranyl diphosphate synthase and copalyl diphosphate synthase; these genes may be endogenous genes or recombinant genes.

I. Steviol and Steviol Glycoside Biosynthesis Polypeptides

A. Steviol Biosynthesis Polypeptides

Figure 1:
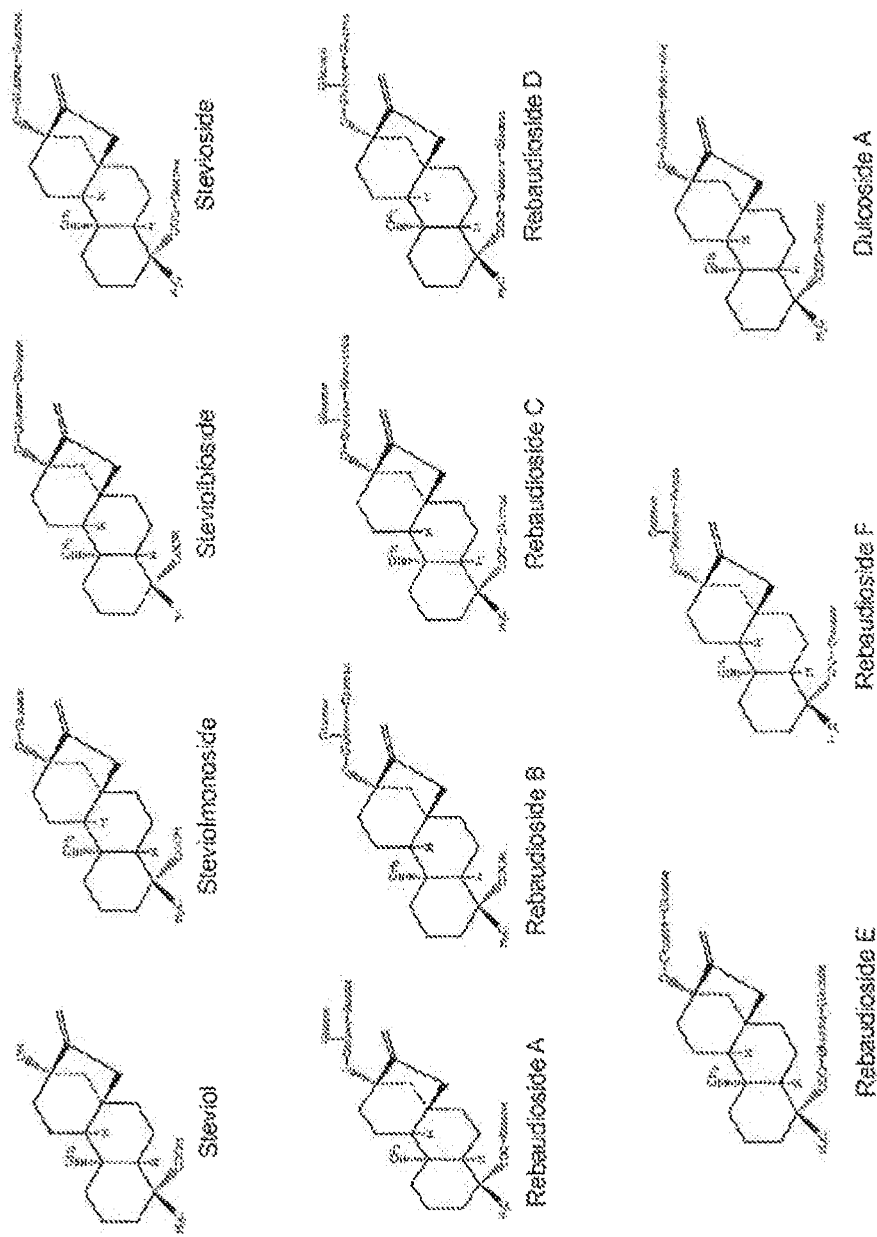
FIG. 1 is the chemical structure of various steviol glycosides.

Chemical structures for several of the compounds found in *Stevia* extracts are shown in FIG. 1, including the diterpene steviol and various steviol glycosides. CAS numbers are shown in Table A below. See also, *Steviol Glycosides Chemical and Technical Assessment 69th JECFA*, prepared by Harriet Wallin, Food Agric. Org. (2007).

TABLE A

| COMPOUND | CAS # |
|---|---|
| Steviol | 471-80-7 |
| Rebaudioside A | 58543-16-1 |
| Steviolbioside | 41093-60-1 |
| Stevioside | 57817-89-7 |
| Rebaudioside B | 58543-17-2 |
| Rebaudioside C | 63550-99-2 |
| Rebaudioside D | 63279-13-0 |
| Rebaudioside E | 63279-14-1 |
| Rebaudioside F | 438045-89-7 |
| Rubusoside | 63849-39-4 |
| Dulcoside A | 64432-06-0 |

It has been discovered that expression of certain genes in a host such as a microorganism confers the ability to synthesize steviol glycosides upon that host. As discussed in more detail below, one or more of such genes may be present naturally in a host. Typically, however, one or more of such genes are recombinant genes that have been transformed into a host that does not naturally possess them.

The biochemical pathway to produce steviol involves formation of geranylgeranyl diphosphate, cyclization to (−) copalyl diphosphate, followed by oxidation and hydroxylation to form steviol. Thus, conversion of geranylgeranyl diphosphate to steviol in a recombinant microorganism involves the expression of a gene encoding a kaurene synthase (KS), a gene encoding a kaurene oxidase (KO), and a gene encoding a steviol synthetase (KAH). Steviol synthetase also is known as kaurenoic acid β-hydroxylase.

Suitable KS polypeptides are known. For example, suitable KS enzymes include those made by *Stevia rebaudiana, Zea mays, Populus trichocarpa*, and *Arabidopsis thaliana*. See, Table 1 and SEQ ID NOs: 132-135 and 156. Nucleotide sequences encoding these polypeptides are set forth in SEQ ID NOs: 40-47 and 155. The nucleotide sequences set forth in SEQ ID NOs:40-43 were modified for expression in yeast while the nucleotide sequences set forth in SEQ ID NOs: 44-47 are from the source organisms from which the KS polypeptides were identified.

TABLE 1

KS Clones

| Enzyme Source Organism | gi Number | Accession Number | Construct Name | Length (nts) | SEQ ID (DNA) | SEQ ID (protein) |
|---|---|---|---|---|---|---|
| *Stevia rebaudiana* | 4959241 | AAD34295 | MM-12 | 2355 | 40 | 132 |
| *Stevia rebaudiana* | 4959239 | AAD34294 | MM-13 | 2355 | 41 | 133 |
| *Zea mays* | 162458963 | NP_001105097 | MM-14 | 1773 | 42 | 134 |
| *Populus trichocarpa* | 224098838 | XP_002311286 | MM-15 | 2232 | 43 | 135 |
| *Arabidopsis thaliana* | 3056724 | AF034774 | EV-70 | 2358 | 155 | 156 |

Suitable KO polypeptides are known. For example, suitable KO enzymes include those made by *Stevia rebaudiana, Arabidopsis thaliana, Gibberella fujikoroi* and *Trametes versicolor*. See, Table 2 and SEQ ID NOs: 138-141. Nucleotide sequences encoding these polypeptides are set forth in SEQ ID NOs: 52-59. The nucleotide sequences set forth in SEQ ID NOs: 52-55 were modified for expression in yeast. The nucleotide sequences set forth in SEQ ID NOs: 56-59 are from the source organisms from which the KO polypeptides were identified.

TABLE 2

| KO Clones | | | | | | |
|---|---|---|---|---|---|---|
| Enzyme Source Organism | gi Number | Accession Number | Construct Name | Length (nts) | SEQ ID (DNA) | SEQ ID (protein) |
| *Stevia rebaudiana* | 76446107 | ABA42921 | MM-18 | 1542 | 52 | 138 |
| *Arabidopsis thaliana* | 3342249 | AAC39505 | MM-19 | 1530 | 53 | 139 |
| *Gibberella fujikoroi* | 4127832 | CAA76703 | MM-20 | 1578 | 54 | 140 |
| *Trametes versicolor* | 14278967 | BAB59027 | MM-21 | 1500 | 55 | 141 |

Suitable KAH polypeptides are known. For example, suitable KAH enzymes include those made by *Stevia rebaudiana, Arabidopsis thaliana, Vitis vinifera* and *Medicago trunculata*. See, e.g., Table 3, SEQ ID NOs: 142-146; U.S. Patent Publication No. 2008-0271205; U.S. Patent Publication No. 2008-0064063 and Genbank Accession No. gi 189098312. The steviol synthetase from *Arabidopsis thaliana* is classified as a CYP714A2. Nucleotide sequences encoding these KAH enzymes are set forth in SEQ ID NOs: 60-69. The nucleotide sequences set forth in SEQ ID NOs: 60-64 were modified for expression in yeast while the nucleotide sequences from the source organisms from which the polypeptides were identified are set forth in SEQ ID NOs: 65-69.

TABLE 3

| KAH Clones | | | | | | | |
|---|---|---|---|---|---|---|---|
| Enzyme Source Organism | gi Number | Accession Number | Plasmid Name | Construct Name | Length (nts) | SEQ ID (DNA) | SEQ ID (protein) |
| *Stevia rebaudiana* | | —* | pMUS35 | MM-22 | 1578 | 60 | 142 |
| *Stevia rebaudiana* | 189418962 | ACD93722 | pMUS36 | MM-23 | 1431 | 61 | 143 |
| *Arabidopsis thaliana* | 15238644 | NP_197872 | pMUS37 | MM-24 | 1578 | 62 | 144 |
| *Vitis vinifera* | 225458454 | XP_002282091 | pMUS38 | MM-25 | 1590 | 63 | 145 |
| *Medicago trunculata* | 84514135 | ABC59076 | pMUS39 | MM-26 | 1440 | 64 | 146 |

*= Sequence is shown in U.S. Patent Publication No. 2008-0064063.

In addition, a KAH polypeptide from *Stevia rebaudiana* that was identified herein is particularly useful in a recombinant host. The nucleotide sequence (SEQ ID NO:163) encoding the *S. rebaudiana* KAH (SrKAHe1) (SEQ ID NO:164) is set forth in FIG. 12A. A nucleotide sequence encoding the *S. rebaudiana* KAH that has been codon-optimized for expression in yeast (SEQ ID NO:165) is set forth in FIG. 12B. The amino acid sequence of the *S. rebaudiana* KAH is set forth in FIG. 12C. The *S. rebaudiana* KAH shows significantly higher steviol synthase activity as compared to the *Arabidopsis thaliana* ent-kaurenoic acid hydroxylase described by Yamaguchi et al. (U.S. Patent Publication No. 2008/0271205 A1) when expressed in *S. cerevisiae*. The *S. rebaudiana* KAH polypeptide set forth in FIG. 12C has less than 20% identity to the KAH from U.S. Patent Publication No. 2008/0271205, and less than 35% identity to the KAH from U.S. Patent Publication No. 2008/0064063.

In some embodiments, a recombinant microorganism contains a recombinant gene encoding a KO and/or a KAH polypeptide. Such microorganisms also typically contain a recombinant gene encoding a cytochrome P450 reductase (CPR) polypeptide, since certain combinations of KO and/or KAH polypeptides require expression of an exogenous CPR polypeptide. In particular, the activity of a KO and/or a KAH polypeptide of plant origin can be significantly increased by the inclusion of a recombinant gene encoding an exogenous CPR polypeptide. Suitable CPR polypeptides are known. For example, suitable CPR enzymes include those made by *Stevia rebaudiana* and *Arabidopsis thaliana*. See, e.g., Table 4 and SEQ ID NOs: 147 and 148. Nucleotide sequences encoding these polypeptides are set forth in SEQ ID NOs: 70, 71, 73, and 74. The nucleotide sequences set forth in SEQ ID NOs: 70-72 were modified for expression in yeast. The nucleotide sequences from the source organisms from which the polypeptides were identified are set forth in SEQ ID NOs:73-75.

TABLE 4

CPR Clones

| Enzyme Source Organism | gi Number | Accession Number | Plasmid Name | Construct Name | Length (nts) | SEQ ID (DNA) | SEQ ID (protein) |
|---|---|---|---|---|---|---|---|
| *Stevia rebaudiana* | 93211213 | ABB88839 | pMUS40 | MM-27 | 2133 | 70 | 147 |
| *Arabidopsis thaliana* | 15233853 | NP_194183 | pMUS41 | MM-28 | 2079 | 71 | 148 |
| *Giberella fujikuroi* | 32562989 | CAE09055 | pMUS42 | MM-29 | 2142 | 72 | 149 |

For example, the steviol synthase encoded by SrKAHe1 is activated by the *S. cerevisiae* CPR encoded by gene NCP1 (YHR042W). Even better activation of the steviol synthase encoded by SrKAHe1 is observed when the *Arabidopsis thaliana* CPR encoded by the gene ATR2 or the *S. rebaudiana* CPR encoded by the gene CPR8 are co-expressed. FIG. 13A contains the amino acid sequence of the *S. cerevisiae, A. thaliana* (from ATR1 and ATR2 genes) and *S. rebaudiana* CPR polypeptides (from CPR7 and CPR8 genes) (SEQ ID NOs: 166-170). FIG. 13B contains the nucleotide sequence encoding the *A. thaliana* and *S. rebaudiana* CPR polypeptides (SEQ ID NOs:171-174).

For example, the yeast gene DPP1 and/or the yeast gene LPP1 can be disrupted or deleted such that the degradation of farnesyl pyrophosphate (FPP) to farnesol is reduced and the degradation of geranylgeranylpyrophosphate (GGPP)) to geranylgeraniol (GGOH) is reduced. Alternatively, the promoter or enhancer elements of an endogenous gene encoding a phosphatase can be altered such that the expression of their encoded proteins is altered. Homologous recombination can be used to disrupt an endogenous gene. For example, a "gene replacement" vector can be constructed in such a way to include a selectable marker gene. The selectable marker gene can be operably linked, at both 5' and 3' end, to portions of the gene of sufficient length to mediate homologous recombination. The selectable marker can be one of any number of genes that complement host cell auxotrophy, provide antibiotic resistance, or result in a color change. Linearized DNA fragments of the gene replacement vector then are introduced into the cells using methods well known in the art (see below). Integration of the linear fragments into the genome and the disruption of the gene can be determined based on the selection marker and can be verified by, for example, Southern blot analysis. Subsequent to its use in selection, a selectable marker can be removed from the genome of the host cell by, e.g., Cre-loxP systems (see, e.g., Gossen et al. (2002) *Ann. Rev. Genetics* 36:153-173 and U.S. Application Publication No. 20060014264). Alternatively, a gene replacement vector can be constructed in such a way as to include a portion of the gene to be disrupted, where the portion is devoid of any endogenous gene promoter sequence and encodes none, or an inactive fragment of, the coding sequence of the gene. An "inactive fragment" is a fragment of the gene that encodes a protein having, e.g., less than about 10% (e.g., less than about 9%, less than about 8%, less than about 7%, less than about 6%, less than about 5%, less than about 4%, less than about 3%, less than about 2%, less than about 1%, or 0%) of the activity of the protein produced from the full-length coding sequence of the gene. Such a portion of the gene is inserted in a vector in such a way that no known promoter sequence is operably linked to the gene sequence, but that a stop codon and a transcription termination sequence are operably linked to the portion of the gene sequence. This vector can be subsequently linearized in the portion of the gene sequence and transformed into a cell. By way of single homologous recombination, this linearized vector is then integrated in the endogenous counterpart of the gene.

Expression in a recombinant microorganism of these genes results in the conversion of geranylgeranyl diphosphate to steviol.

B. Steviol Glycoside Biosynthesis Polypeptides

A recombinant host described herein can convert steviol to a steviol glycoside. Such a host (e.g., microorganism) contains genes encoding one or more UDP Glycosyl Transferases, also known as UGTs. UGTs transfer a monosaccharide unit from an activated nucleotide sugar to an acceptor moiety, in this case, an —OH or —COOH moiety on steviol or steviol derivative. UGTs have been classified into families and subfamilies based on sequence homology. Li et al. *J. Biol. Chem.* 276:4338-4343 (2001).

B. 1 Rubusoside Biosynthesis Polypeptides

Figure 2A:
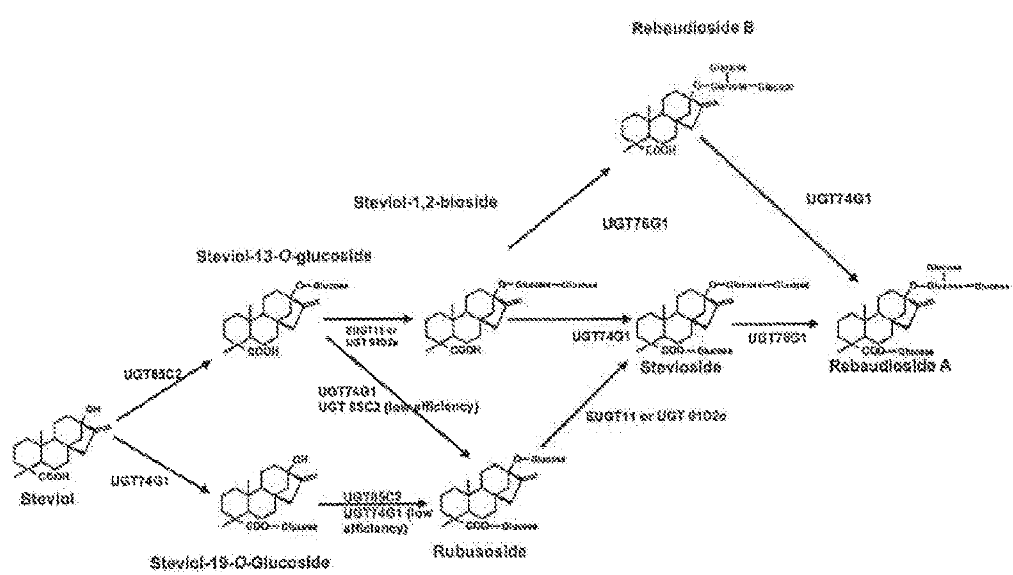
FIGS. 2A-D show representative pathways for the biosynthesis of steviol glycosides from steviol.
Figure 2B:
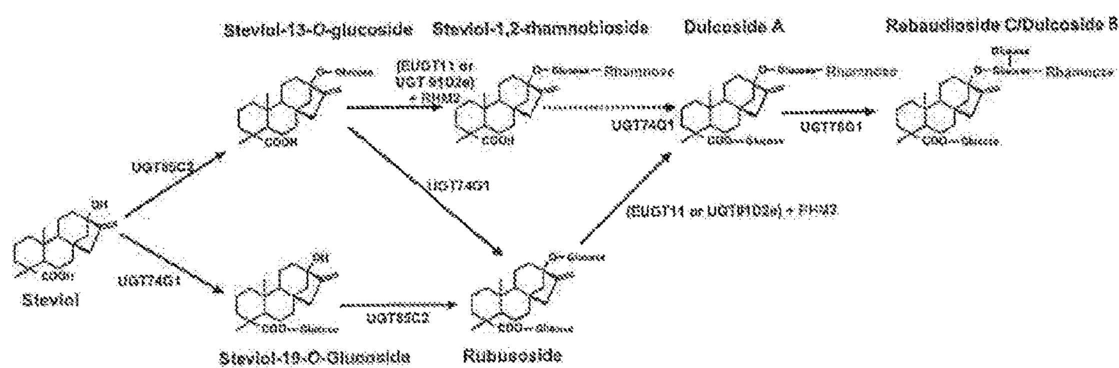

The biosynthesis of rubusoside involves glycosylation of the 13-OH and the 19-COOH of steviol. See FIG. 2A. Conversion of steviol to rubusoside in a recombinant host such as a microorganism can be accomplished by the expression of gene(s) encoding UGTs 85C2 and 74G1, which transfer a glucose unit to the 13-OH or the 19-COOH, respectively, of steviol.

A suitable UGT85C2 functions as a uridine 5'-diphospho glucosyl:steviol 13-OH transferase, and a uridine 5'-diphospho glucosyl:steviol-19-O-glucoside 13-OH transferase. Functional UGT85C2 polypeptides also may catalyze glucosyl transferase reactions that utilize steviol glycoside substrates other than steviol and steviol-19-O-glucoside.

A suitable UGT74G1 polypeptide functions as a uridine 5'-diphospho glucosyl: steviol 19-COOH transferase and a uridine 5'-diphospho glucosyl: steviol-13-O-glucoside 19-COOH transferase. Functional UGT74G1 polypeptides also may catalyze glycosyl transferase reactions that utilize steviol glycoside substrates other than steviol and steviol-13-O-glucoside, or that transfer sugar moieties from donors other than uridine diphosphate glucose.

A recombinant microorganism expressing a functional UGT74G1 and a functional UGT85C2 can make rubusoside and both steviol monosides (i.e., steviol 13-O-monoglucoside and steviol 19-O-monoglucoside) when steviol is used as a feedstock in the medium. One or more of such genes may be present naturally in the host. Typically, however, such genes are recombinant genes that have been transformed into a host (e.g., microorganism) that does not naturally possess them.

As used herein, the term recombinant host is intended to refer to a host, the genome of which has been augmented by at least one incorporated DNA sequence. Such DNA sequences include but are not limited to genes that are not naturally present, DNA sequences that are not normally transcribed into RNA or translated into a protein ("expressed"), and other genes or DNA sequences which one desires to introduce into the non-recombinant host. It will be appreciated that typically the genome of a recombinant host described herein is augmented through the stable introduction of one or more recombinant genes. Generally, the introduced DNA is not originally resident in the host that is the recipient of the DNA, but it is within the scope of the invention to isolate a DNA segment from a given host, and to subsequently introduce one or more additional copies of that DNA into the same host, e.g., to enhance production of the product of a gene or alter the expression pattern of a gene. In some instances, the introduced DNA will modify or even replace an endogenous gene or DNA sequence by, e.g., homologous recombination or site-directed mutagenesis. Suitable recombinant hosts include microorganisms, plant cells, and plants.

The term "recombinant gene" refers to a gene or DNA sequence that is introduced into a recipient host, regardless of whether the same or a similar gene or DNA sequence may already be present in such a host. "Introduced," or "augmented" in this context, is known in the art to mean introduced or augmented by the hand of man. Thus, a recombinant gene may be a DNA sequence from another species, or may be a DNA sequence that originated from or is present in the same species, but has been incorporated into a host by recombinant methods to form a recombinant host. It will be appreciated that a recombinant gene that is introduced into a host can be identical to a DNA sequence that is normally present in the host being transformed, and is introduced to provide one or more additional copies of the DNA to thereby permit overexpression or modified expression of the gene product of that DNA.

83, and 85, respectively. See also the UGT85C2 and UGT74G1 variants described below in the "Functional Homolog" section. For example, an UGT85C2 polypeptide containing substitutions at positions 65, 71, 270, 289, and 389 can be used (e.g., A65S, E71Q, T270M, Q289H, and A389V).

In some embodiments, the recombinant host is a microorganism. The recombinant microorganism can be grown on media containing steviol in order to produce rubusoside. In other embodiments, however, the recombinant microorganism expresses one or more recombinant genes involved in steviol biosynthesis, e.g., a CDPS gene, a KS gene, a KO gene and/or a KAH gene. Suitable CDPS polypeptides are known. For example, suitable CDPS enzymes include those made by *Stevia rebaudiana, Streptomyces clavuligerus, Bradyrhizobium japonicum, Zea mays*, and *Arabidopsis*. See, e.g., Table 5 and SEQ ID NOs: 129-131, 158, and 160. Nucleotide sequences encoding these polypeptides are set forth in SEQ ID NOs: 34-39, 157, and 159. The nucleotide sequences set forth in SEQ ID NOs: 34-36 were modified for expression in yeast. The nucleotide sequences from the source organisms from which the polypeptides were identified are set forth in SEQ ID NOs:37-39.

In some embodiments, CDPS polypeptides that lack a chloroplast transit peptide at the amino terminus of the unmodified polypeptide can be used. For example, the first 150 nucleotides from the 5' end of the *Zea mays* CDPS coding sequence shown in FIG. 14 (SEQ ID NO:157) can be removed. Doing so removes the amino terminal 50 residues of the amino acid sequence shown in FIG. 14 (SEQ ID NO:158), which encode a chloroplast transit peptide. The truncated CDPS gene can be fitted with a new ATG translation start site and operably linked to a promoter, typically a constitutive or highly expressing promoter. When a plurality of copies of the truncated coding sequence are introduced into a microorganism, expression of the CDPS polypeptide from the promoter results in an increased carbon flux towards ent-kaurene biosynthesis.

TABLE 5

CDPS Clones

| Enzyme Source Organism | gi Number | Accession Number | Plasmid Name | Construct Name | Length (nts) | SEQ ID: (DNA) | SEQ ID (protein) |
|---|---|---|---|---|---|---|---|
| *Stevia rebaudiana* | 2642661 | AAB87091 | pMUS22 | MM-9 | 2364 | 34 | 129 |
| *Streptomyces clavuligerus* | 197705855 | EDY51667 | pMUS23 | MM-10 | 1584 | 35 | 130 |
| *Bradyrhizobium japonicum* | 529968 | AAC28895.1 | pMUS24 | MM-11 | 1551 | 36 | 131 |
| *Zea mays* | 50082774 | AY562490 | | EV65 | 2484 | 157 | 158 |
| *Arabidopsis thaliana* | 18412041 | NM_116512 | | EV64 | 2409 | 159 | 160 |

Suitable UGT74G1 and UGT85C2 polypeptides include those made by *Stevia rebaudiana*. Genes encoding functional UGT74G1 and UGT85C2 polypeptides from *Stevia* are reported in Richman, et al. *Plant J.* 41: 56-67 (2005). Amino acid sequences of *S. rebaudiana* UGT74G1 and UGT85C2 polypeptides are set forth in SEQ ID NOs: 1 and 3, respectively. Nucleotide sequences encoding UGT74G1 and UGT85C2 that have been optimized for expression in yeast are set forth in SEQ ID NOs: 2 and 4, respectively. DNA 2.0 codon-optimized sequence for UGTs 85C2, 91D2e, 74G1 and 76G1 are set forth in SEQ ID NOs: 82, 84, CDPS-KS bifunctional proteins (SEQ ID NOs: 136 and 137) also can be used. Nucleotide sequences encoding the CDPS-KS bifunctional enzymes shown in Table 6 were modified for expression in yeast (see SEQ ID NOs: 48 and 49). The nucleotide sequences from the source organisms from which the polypeptides were originally identified are set forth in SEQ ID NOs: 50 and 51. A bifunctional enzyme from *Gibberella fujikuroi* (SEQ ID NO:162) also can be used. A nucleotide sequence encoding the *Gibberella fujikuroi* bifunctional CDPS-KS enzyme was modified for expression in yeast (see FIG. 15A, SEQ ID NO:161).

TABLE 6

| CDPS-KS Clones | | | | | | |
|---|---|---|---|---|---|---|
| Enzyme Source Organism | gi Number | Accession Number | Construct Name | Length (nts) | SEQ ID (DNA) | SEQ ID (protein) |
| *Phomopsis amygdali* | 186704306 | BAG30962 | MM-16 | 2952 | 48 | 136 |
| *Physcomitrella patens* | 146325986 | BAF61135 | MM-17 | 2646 | 49 | 137 |
| *Gibberella fujikuroi* | 62900107 | Q9UVY5.1 | | 2859 | 161 | 162 |

Thus, a microorganism containing a CDPS gene, a KS gene, a KO gene and a KAH gene in addition to a UGT74G1 and a UGT85C2 gene is capable of producing both steviol monosides and rubusoside without the necessity for using steviol as a feedstock.

In some embodiments, the recombinant microorganism further expresses a recombinant gene encoding a geranylgeranyl diphosphate synthase (GGPPS). Suitable GGPPS polypeptides are known. For example, suitable GGPPS enzymes include those made by *Stevia rebaudiana, Gibberella fujikuroi, Mus musculus, Thalassiosira pseudonana, Streptomyces clavuligerus, Sulfulobus acidocaldarius, Synechococcus* sp. and *Arabidopsis thaliana*. See, Table 7 and SEQ ID NOs: 121-128. Nucleotide sequences encoding these polypeptides are set forth in SEQ ID NOs:18-33. The nucleotide sequences set forth in SEQ ID NOs: 18-25 were modified for expression in yeast while the nucleotide sequences from the source organisms from which the polypeptides were identified are set forth in SEQ ID NOs: 26-33.

TABLE 7

| GGPPS Clones | | | | | | | |
|---|---|---|---|---|---|---|---|
| Enzyme Source Organism | gi Number | Accession Number | Plasmid Name | Construct Name | Length (nts) | SEQ ID (DNA) | SEQ ID (protein) |
| *Stevia rebaudiana* | 90289577 | ABD92926 | pMUS14 | MM-1 | 1086 | 18 | 121 |
| *Gibberella fujikuroi* | 3549881 | CAA75568 | pMUS15 | MM-2 | 1029 | 19 | 122 |
| *Mus musculus* | 47124116 | AAH69913 | pMUS16 | MM-3 | 903 | 20 | 123 |
| *Thalassiosira pseudonana* | 223997332 | XP_002288339 | pMUS17 | MM-4 | 1020 | 21 | 124 |
| *Streptomyces clavuligerus* | 254389342 | ZP_05004570 | pMUS18 | MM-5 | 1068 | 22 | 125 |
| *Sulfulobus acidocaldarius* | 506371 | BAA43200 | pMUS19 | MM-6 | 993 | 23 | 126 |
| *Synechococcus* sp. | 86553638 | ABC98596 | pMUS20 | MM-7 | 894 | 24 | 127 |
| *Arabidopsis thaliana* | 15234534 | NP_195399 | pMUS21 | MM-8 | 1113 | 25 | 128 |

In some embodiments, the recombinant microorganism further can express recombinant genes involved in diterpene biosynthesis or production of terpenoid precursors, e.g., genes in the methylerythritol 4-phosphate (MEP) pathway or genes in the mevalonate (MEV) pathway discussed below, have reduced phosphatase activity, and/or express a sucrose synthase (SUS) as discussed herein.

B. 2 Rebaudioside A, Rebaudioside D, and Rebaudioside E Biosynthesis Polypeptides The biosynthesis of rebaudioside A involves glucosylation of the aglycone steviol. Specifically, rebaudioside A can be formed by glucosylation of the 13-OH of steviol which forms the 13-O-steviolmonoside, glucosylation of the C-2' of the 13-O-glucose of steviolmonoside which forms steviol-1,2-bioside, glucosylation of the C-19 carboxyl of steviol-1,2-bioside which forms stevioside, and glucosylation of the C-3' of the C-13-O-glucose of stevioside. The order in which each glucosylation reaction occurs can vary. See FIG. 2A.

Figure 2C:
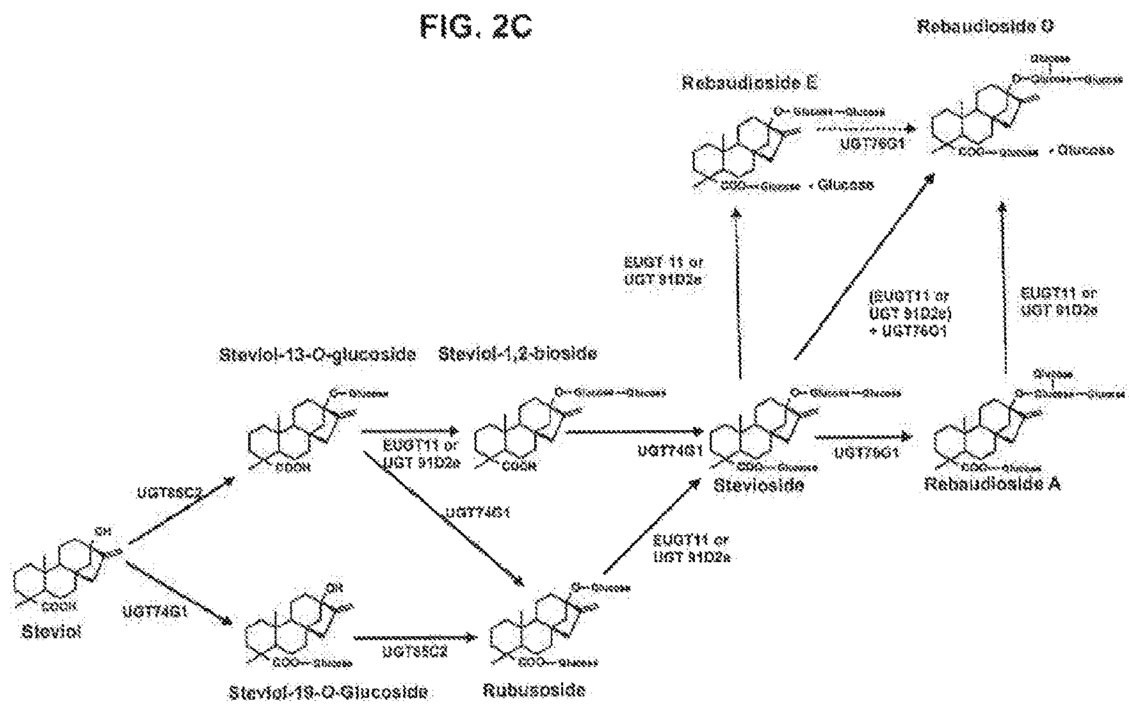
Figure 2D:
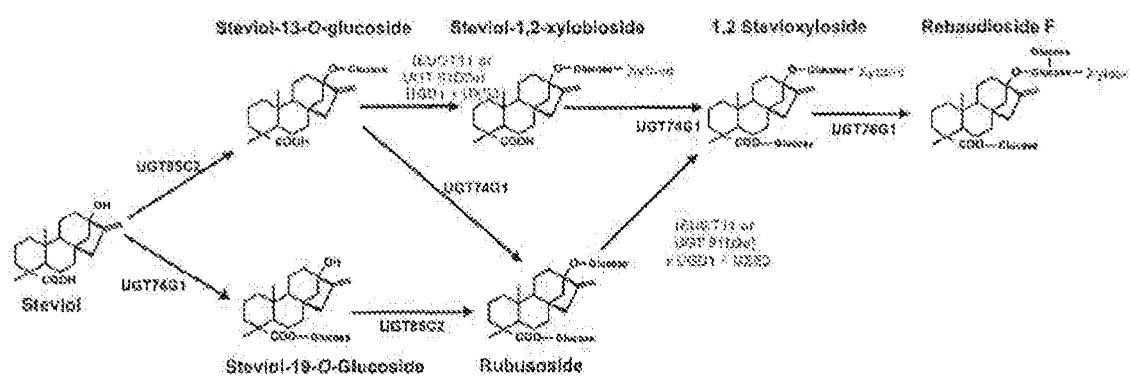

The biosynthesis of rebaudioside E and/or rebaudioside D involves glucosylation of the aglycone steviol. Specifically, rebaudioside E can be formed by glucosylation of the 13-OH of steviol which forms steviol-13-O-glucoside, glucosylation of the C-2' of the 13-O-glucose of steviol-13-O-glucoside which forms the steviol-1,2-bioside, glucosylation of the C-19 carboxyl of the 1,2-bioside to form 1,2-stevioside, and glucosylation of the C-2' of the 19-O-glucose of the 1,2-stevioside to form rebaudioside E. Rebaudioside D can be formed by glucosylation of the C-3' of the C-13-O-glucose of rebaudioside E. The order in which each glycosylation reaction occurs can vary. For example, the glucosylation of the C-2' of the 19-O-glucose may be the last step in the pathway, wherein Rebaudioside A is an intermediate in the pathway. See FIG. 2C.

It has been discovered that conversion of steviol to rebaudioside A, rebaudioside D, and/or rebaudioside E in a recombinant host can be accomplished by expressing the following functional UGTs: EUGT11, 74G1, 85C2, and 76G1, and optionally 91D2. Thus, a recombinant microorganism expressing combinations of these four or five UGTs can make rebaudioside A and rebaudioside D when steviol is used as a feedstock. Typically, one or more of these genes are recombinant genes that have been transformed into a microorganism that does not naturally possess them. It has also been discovered that UGTs designated herein as SM12UGT can be substituted for UGT91D2.

In some embodiments, less than five (e.g., one, two, three, or four) UGTs are expressed in a host. For example, a recombinant microorganism expressing a functional EUGT11 can make rebaudioside D when rebaudioside A is used as a feedstock. A recombinant microorganism expressing two functional UGTs, EUGT11 and 76G1, and optionally a functional 91D12, can make rebaudioside D when rubusoside or 1,2-stevioside is used as a feedstock. As another alternative, a recombinant microorganism expressing three functional UGTs, EUGT11, 74G1, 76G1, and optionally 91D2, can make rebaudioside D when fed the monoside, steviol-13-O-glucoside, in the medium. Similarly, conversion of steviol-19-O-glucoside to rebaudioside D in a recombinant microorganism can be accomplished by the expression of genes encoding UGTs EUGT11, 85C2, 76G1, and optionally 91D2, when fed steviol-19-O-glucoside. Typically, one or more of these genes are recombinant genes that have been transformed into a host that does not naturally possess them.

Suitable UGT74G1 and UGT85C2 polypeptides include those discussed above. A suitable UGT76G1 adds a glucose moiety to the C-3' of the C-13-O-glucose of the acceptor molecule, a steviol 1,2 glycoside. Thus, UGT76G1 functions, for example, as a uridine 5'-diphospho glucosyl: steviol 13-O-1,2 glucoside C-3' glucosyl transferase and a uridine 5'-diphospho glucosyl: steviol-19-O-glucose, 13-O-1,2 bioside C-3' glucosyl transferase. Functional UGT76G1 polypeptides may also catalyze glucosyl transferase reactions that utilize steviol glycoside substrates that contain sugars other than glucose, e.g., steviol rhamnosides and steviol xylosides. See, FIGS. 2A, 2B, 2C and 2D. Suitable UGT76G1 polypeptides include those made by *S. rebaudiana* and reported in Richman, et al. *Plant J.* 41: 56-67 (2005). The amino acid sequence of a *S. rebaudiana UGT*76G1 polypeptide is set forth in SEQ ID NO:7. The nucleotide sequence encoding the UGT76G1 polypeptide of SEQ ID NO:7 has been optimized for expression in yeast and is set forth in SEQ ID NO:8. See also the UGT76G1 variants set forth in the “Functional Homolog” section.

A suitable EUGT11 or UGT91D2 polypeptide functions as a uridine 5'-diphospho glucosyl: steviol-13-O-glucoside transferase (also referred to as a steviol-13-monoglucoside 1,2-glucosylase), transferring a glucose moiety to the C-2' of the 13-O-glucose of the acceptor molecule, steviol-13-O-glucoside.

A suitable EUGT11 or UGT91D2 polypeptide also functions as a uridine 5'-diphospho glucosyl: rubusoside transferase transferring a glucose moiety to the C-2' of the 13-O-glucose of the acceptor molecule, rubusoside, to produce stevioside. EUGT11 polypeptides also can transfer a glucose moiety to the C-2' of the 19-O-glucose of the acceptor molecule, rubusoside, to produce a 19-O-1,2-diglycosylated rubusoside (compound 2 in FIG. 3).

Functional EUGT11 or UGT91D2 polypeptides also can catalyze reactions that utilize steviol glycoside substrates other than steviol-13-O-glucoside and rubusoside. For example, a functional EUGT11 polypeptide may utilize stevioside as a substrate, transferring a glucose moiety to the C-2' of the 19-O-glucose residue to produce Rebaudioside E (see compound 3 in FIG. 3). Functional EUGT11 and UGT91D2 polypeptides may also utilize Rebaudioside A as a substrate, transferring a glucose moiety to the C-2' of the 19-O-glucose residue of Rebaudioside A to produce Rebaudioside D. As set forth in the Examples, EUGT11 can convert Rebaudioside A to Rebaudioside D at a rate that is least 20 times faster (e.g., as least 25 times or at least 30 times faster) than the corresponding rate of UGT91D2e (SEQ ID NO: 5) when the reactions are performed under similar conditions, i.e., similar time, temperature, purity, and substrate concentration. As such, EUGT11 produces greater amounts of RebD than UGT91D2e when incubated under similar conditions.

Figure 3:
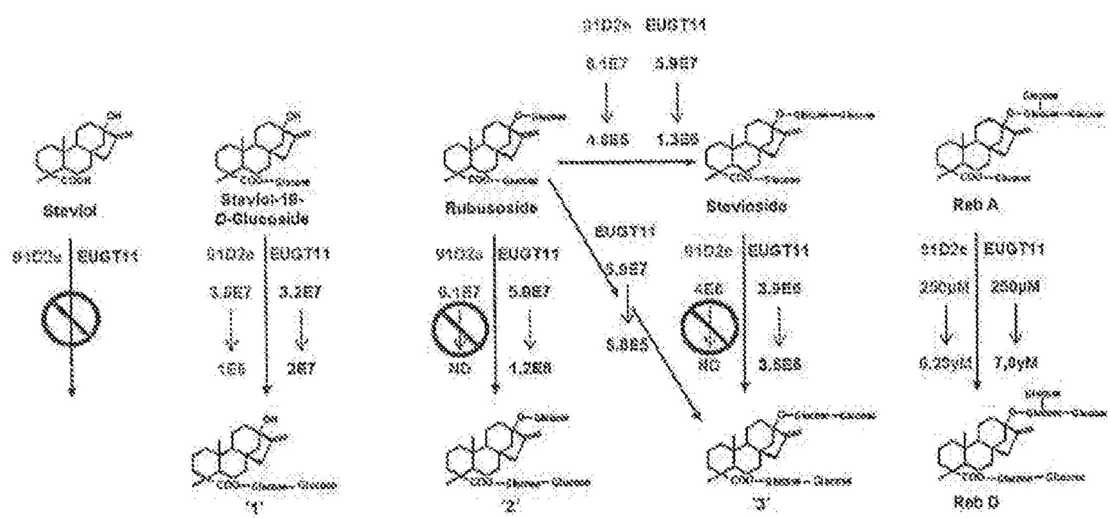
FIG. 3 is a schematic representation of 19-O-1,2-diglycosylation reactions by EUGT11 and UGT91D2e. The numbers are the average signal intensity for the substrates or the products of the reaction, from liquid chromatography-mass spectrometry (LC-MS) chromatograms FIG. 4 contains LC-MS chromatograms showing the production of rebaudioside D (RebD) from Rebaudioside A (RebA) using in vitro transcribed and translated UGT91D2e (SEQ ID NO:5) (left panel) or EUGT11 (SEQ ID NO:152) (right panel). The LC-MS was set to detect certain masses corresponding to steviol+5 glucoses (such as RebD), steviol+4 glucoses (such as RebA) etc. Each ‘lane’ is scaled according to the highest peak.

In addition, a functional EUGT11 exhibits significant C-2' 19-O-diglycosylation activity with rubusoside or stevioside as substrates, whereas UGT91D2e has no detectable diglycosylation activity with these substrates. Thus, a functional EUGT11 can be distinguished from UGT91D2e by the differences in steviol glycoside substrate-specificity. FIG. 3 provides a schematic overview of the 19-O-1,2 diglycosylation reactions that are performed by EUGT11 and UGT91D2e.

A functional EUGT11 or UGT91D2 polypeptide typically does not transfer a glucose moiety to steviol compounds having a 1,3-bound glucose at the C-13 position, i.e., transfer of a glucose moiety to steviol 1,3-bioside and 1,3-stevioside does not occur.

Figure 7:
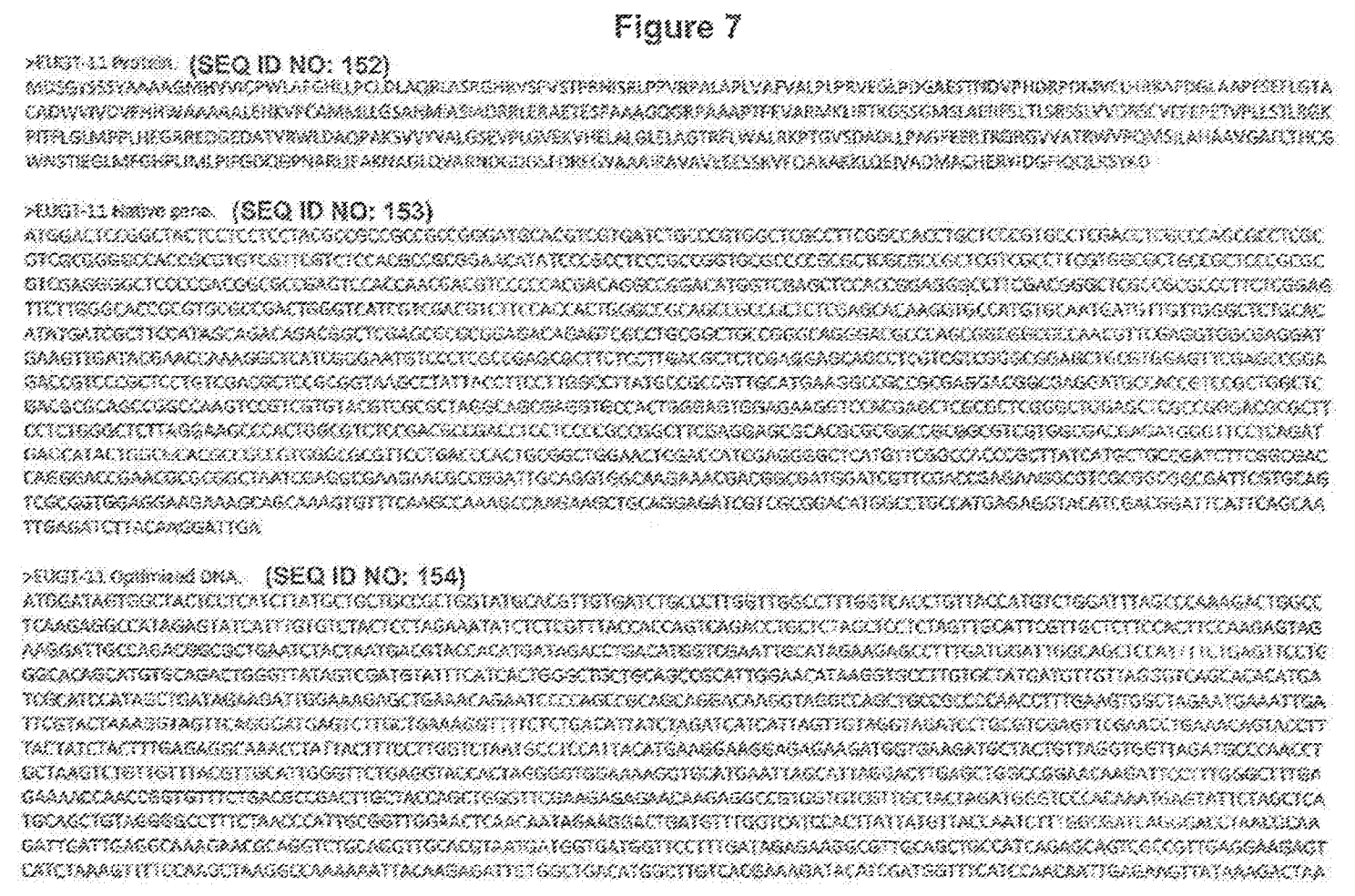

Functional EUGT11 and UGT91D2 polypeptides can transfer sugar moieties from donors other than uridine diphosphate glucose. For example, a functional EUGT11 or UGT91D2 polypeptide can act as a uridine 5'-diphospho D-xylosyl: steviol-13-O-glucoside transferase, transferring a xylose moiety to the C-2' of the 13-O-glucose of the acceptor molecule, steviol-13-O-glucoside. As another example, a functional EUGT11 or UGT91D2 polypeptide can act as a uridine 5'-diphospho L-rhamnosyl: steviol-13-O-glucoside transferase, transferring a rhamnose moiety to the C-2' of the 13-O-glucose of the acceptor molecule, steviol-13-O-glucoside Suitable EUGT11 polypeptides are described herein and can include the EUGT11 polypeptide from *Oryza sativa* (GenBank Accession No. AC133334). For example, an EUGT11 polypeptide can have an amino acid sequence with at least 70% sequence identity (e.g., at least 75, 80, 85, 90, 95, 96, 97, 98, or 99% sequence identity) to the amino acid sequence set forth in SEQ ID NO: 152 (see FIG. 7). The nucleotide sequence encoding the amino acid sequence of SEQ ID NO: 152 is set forth in SEQ ID NO: 153. SEQ ID NO: 154 is a nucleotide sequence encoding the polypeptide of SEQ ID NO: 152 that has been codon optimized for expression in yeast.

Suitable functional UGT91D2 polypeptides include those disclosed herein, e.g., the polypeptides designated UGT91D2e and UGT91D2m. The amino acid sequence of an exemplary UGT91D2e polypeptide from *Stevia rebaudiana* is set forth in SEQ ID NO: 5. SEQ ID NO:6 is a nucleotide sequence encoding the polypeptide of SEQ ID NO:5 that has been codon optimized for expression in yeast. The *S. rebaudiana* nucleotide sequence encoding the polypeptide of SEQ ID NO:5 is set forth in SEQ ID NO:9. The amino acid sequences of exemplary UGT91D2m polypeptides from *S. rebaudiana* are set forth in SEQ ID NOs: 10 and 12, and are encoded by the nucleic acid sequences set forth in SEQ ID NOs: 11 and 13, respectively. In addition, UGT91D2 variants containing a substitution at amino acid residues 206, 207, and 343 of SEQ ID NO: 5 can be used. For example, the amino acid sequence set forth in SEQ ID NO:95 and having the following mutations with respect to wild-type UGT92D2e (SEQ ID NO:5) G206R, Y207C, and W343R can be used. In addition, a UGT91D2 variant containing substitutions at amino acid residues 211 and 286 can be used. For example, a UGT91D2 variant can include a substitution of a methionine for leucine at position 211 and a substitution of an alanine for valine at position 286 of SEQ ID NO:5 (UGT91D2e-b).

As indicated above, UGTs designated herein as SM12UGT can be substituted for UGT91D2. Suitable functional SM12UGT polypeptides include those made by *Ipomoea purpurea* (Japanese morning glory) and described in Morita et al. *Plant J.* 42, 353-363 (2005). The amino acid sequence encoding the *I. purpurea* IP3GGT polypeptide is set forth in SEQ ID NO:76. SEQ ID NO:77 is a nucleotide sequence encoding the polypeptide of SEQ ID NO:76 that has been codon optimized for expression in yeast. Another suitable SM12UGT polypeptide is a Bp94B1 polypeptide having an R25S mutation. See Osmani et al. *Plant Phys.* 148: 1295-1308 (2008) and Sawada et al. *J. Biol. Chem.* 280:899-906 (2005). The amino acid sequence of the *Bellis perennis* (red daisy) UGT94B1 polypeptide is set forth in SEQ ID NO:78. SEQ ID NO:79 is the nucleotide sequence encoding the polypeptide of SEQ ID NO:78 that has been codon optimized for expression in yeast.

In some embodiments, the recombinant microorganism is grown on media containing steviol-13-O-glucoside or steviol-19-O-glucoside in order to produce rebaudioside A and/or rebaudioside D. In such embodiments, the microorganism contains and expresses genes encoding a functional EUGT11, a functional UGT74G1, a functional UGT85C2, a functional UGT76G1, and an optional functional UGT91D2, and is capable of accumulating rebaudioside A and rebaudioside D when steviol, one or both of the steviolmonosides, or rubusoside is used as feedstock.

In other embodiments, the recombinant microorganism is grown on media containing rubusoside in order to produce rebaudioside A and/or rebaudioside D. In such embodiments, the microorganism contains and expresses genes encoding a functional EUGT11, a functional UGT76G1, and an optional functional UGT91D2, and is capable of producing rebaudioside A and/or rebaudioside D when rubusoside is used as feedstock.

In other embodiments the recombinant microorganism expresses one or more genes involved in steviol biosynthesis, e.g., a CDPS gene, a KS gene, a KO gene and/or a KAH gene. Thus, for example, a microorganism containing a CDPS gene, a KS gene, a KO gene and a KAH gene, in addition to a EUGT11, a UGT74G1, a UGT85C2, a UGT76G1, and optionally a functional UGT91D2 (e.g., UGT91D2e), is capable of producing rebaudioside A, rebaudioside D, and/or rebaudioside E without the necessity for including steviol in the culture media.

In some embodiments, the recombinant host further contains and expresses a recombinant GGPPS gene in order to provide increased levels of the diterpene precursor geranylgeranyl diphosphate, for increased flux through the steviol biosynthetic pathway. In some embodiments, the recombinant host further contains a construct to silence the expression of non-steviol pathways consuming geranylgeranyl diphosphate, ent-Kaurenoic acid or farnesyl pyrophosphate, thereby providing increased flux through the steviol and steviol glycosides biosynthetic pathways. For example, flux to sterol production pathways such as ergosterol may be reduced by downregulation of the ERG9 gene. See, the ERG9 section below and Examples 24-25. In cells that produce gibberellins, gibberellin synthesis may be downregulated to increase flux of ent-kaurenoic acid to steviol. In carotenoid-producing organisms, flux to steviol may be increased by downregulation of one or more carotenoid biosynthetic genes. In some embodiments, the recombinant microorganism further can express recombinant genes involved in diterpene biosynthesis or production of terpenoid precursors, e.g., genes in the MEP or MEV) pathways discussed below, have reduced phosphatase activity, and/or express a SUS as discussed herein.

One with skill in the art will recognize that by modulating relative expression levels of different UGT genes, a recombinant host can be tailored to specifically produce steviol glycoside products in a desired proportion. Transcriptional regulation of steviol biosynthesis genes and steviol glycoside biosynthesis genes can be achieved by a combination of transcriptional activation and repression using techniques known to those in the art. For in vitro reactions, one with skill in the art will recognize that addition of different levels of UGT enzymes in combination or under conditions which impact the relative activities of the different UGTS in combination will direct synthesis towards a desired proportion of each steviol glycoside. One with skill in the art will recognize that a higher proportion of rebaudioside D or E or more efficient conversion to rebaudioside D or E can be obtained with a diglycosylation enzyme that has a higher activity for the 19-O-glucoside reaction as compared to the 13-O-glucoside reaction (substrates rebaudioside A and stevioside).

In some embodiments, a recombinant host such as a microorganism produces rebaudioside D-enriched steviol glycoside compositions that have greater than at least 3% rebaudioside D by weight total steviol glycosides, e.g., at least 4% rebaudioside D at least 5% rebaudioside D, 10-20% rebaudioside D, 20-30% rebaudioside D, 30-40% rebaudioside D, 40-50% rebaudioside D, 50-60% rebaudioside D, 60-70% rebaudioside D, 70-80% rebaudioside D. In some embodiments, a recombinant host such as a microorganism produces steviol glycoside compositions that have at least 90% rebaudioside D, e.g., 90-99% rebaudioside D. Other steviol glycosides present may include those depicted in FIG. 2C such as steviol monosides, steviol glucobiosides, rebaudioside A, rebaudioside E, and stevioside. In some embodiments, the rebaudioside D-enriched composition produced by the host (e.g., microorganism) can be further purified and the rebaudioside D or rebaudioside E so purified can then be mixed with other steviol glycosides, flavors, or sweeteners to obtain a desired flavor system or sweetening composition. For instance, a rebaudioside D-enriched composition produced by a recombinant host can be combined with a rebaudioside A, C, or F-enriched composition produced by a different recombinant host, with rebaudioside A, F, or C purified from a *Stevia* extract, or with rebaudioside A, F, or C produced in vitro.

In some embodiments, rebaudioside A, rebaudioside D, rebaudioside B, steviol monoglucosides, steviol-1,2-bioside, rubusoside, stevioside, or rebaudioside E can be produced using in vitro methods while supplying the appropriate UDP-sugar and/or a cell-free system for regeneration of UDP-sugars. See, for example, Jewett M C, et al. *Molecular Systems Biology*, Vol. 4, article 220 (2008); Masada S et al. *FEBS Letters*, Vol. 581, 2562-2566 (2007). In some embodiments, sucrose and a sucrose synthase may be provided in the reaction vessel in order to regenerate UDP-glucose from the UDP generated during glycosylation reactions. See FIG. 11. The sucrose synthase can be from any suitable organism. For example, a sucrose synthase coding sequence from *Arabidopsis thaliana, Stevia rebaudiana*, or *Coffea arabica* can be cloned into an expression plasmid under control of a suitable promoter, and expressed in a host such as a microorganism or a plant.

Conversions requiring multiple reactions may be carried out together, or stepwise. For example, rebaudioside D may be produced from rebaudioside A that is commercially available as an enriched extract or produced via biosynthesis, with the addition of stoichiometric or excess amounts of UDP-glucose and EUGT11. As an alternative, rebaudioside D may be produced from steviol glycoside extracts that are enriched for stevioside and rebaudioside A, using EUGT11 and a suitable UGT76G1 enzyme. In some embodiments, phosphatases are used to remove secondary products and improve the reaction yields. UGTs and other enzymes for in vitro reactions may be provided in soluble forms or in immobilized forms.

In some embodiments, rebaudioside A, rebaudioside D, or rebaudioside E can be produced using whole cells that are fed raw materials that contain precursor molecules such as steviol and/or steviol glycosides, including mixtures of steviol glycosides derived from plant extracts. The raw materials may be fed during cell growth or after cell growth. The whole cells may be in suspension or immobilized. The whole cells may be entrapped in beads, for example calcium or sodium alginate beads. The whole cells may be linked to a hollow fiber tube reactor system. The whole cells may be concentrated and entrapped within a membrane reactor system. The whole cells may be in fermentation broth or in a reaction buffer. In some embodiments, a permeabilizing agent is utilized for efficient transfer of substrate into the cells. In some embodiments, the cells are permeabilized with a solvent such as toluene, or with a detergent such as Triton-X or Tween. In some embodiments, the cells are permeabilized with a surfactant, for example a cationic surfactant such as cetyltrimethylammonium bromide (CTAB). In some embodiments, the cells are permeabilized with periodic mechanical shock such as electroporation or a slight osmotic shock. The cells can contain one recombinant UGT or multiple recombinant UGTs. For example, the cells can contain UGT 76G1 and EUGT11 such that mixtures of stevioside and RebA are efficiently converted to RebD. In some embodiments, the whole cells are the host cells described in section III A. In some embodiments, the whole cells are a Gram-negative bacterium such as *E. coli*. In some embodiments, the whole cell is a Gram-positive bacterium such as *Bacillus*. In some embodiments, the whole cell is a fungal species such as *Aspergillus*, or a yeast such as *Saccharomyces*. In some embodiments, the term "whole cell biocatalysis" is used to refer to the process in which the whole cells are grown as described above (e.g., in a medium and optionally permeabilized) and a substrate such as rebA or stevioside is provided and converted to the end product using the enzymes from the cells. The cells may or may not be viable, and may or may not be growing during the bioconversion reactions. In contrast, in fermentation, the cells are cultured in a growth medium and fed a carbon and energy source such as glucose and the end product is produced with viable cells.

B. 3 Dulcoside A and Rebaudioside C Biosynthesis Polypeptides

The biosynthesis of rebaudioside C and/or dulcoside A involves glucosylation and rhamnosylation of the aglycone steviol. Specifically, dulcoside A can be formed by glucosylation of the 13-OH of steviol which forms steviol-13-O-glucoside, rhamnosylation of the C-2' of the 13-O-glucose of steviol-13-O-glucoside which forms the 1,2 rhamnobioside, and glucosylation of the C-19 carboxyl of the 1,2 rhamnobioside. Rebaudioside C can be formed by glucosylation of the C-3' of the C-13-O-glucose of dulcoside A. The order in which each glycosylation reaction occurs can vary. See FIG. 2B.

It has been discovered that conversion of steviol to dulcoside A in a recombinant host can be accomplished by the expression of gene(s) encoding the following functional UGTs: 85C2, EUGT11 and/or 91D2e, and 74G1. Thus, a recombinant microorganism expressing these three or four UGTs and a rhamnose synthetase can make dulcoside A when fed steviol in the medium. Alternatively, a recombinant microorganism expressing two UGTs, EUGT11 and 74G1, and rhamnose synthetase can make dulcoside A when fed the monoside, steviol-13-O-glucoside or steviol-19-O-glucoside, in the medium. Similarly, conversion of steviol to rebaudioside C in a recombinant microorganism can be accomplished by the expression of gene(s) encoding UGTs 85C2, EUGT11, 74G1, 76G1, optionally 91D2e, and rhamnose synthetase when fed steviol, by the expression of genes encoding UGTs EUGT11 and/or 91D2e, 74G1, and 76G1, and rhamnose synthetase when fed steviol-13-O-glucoside, by the expression of genes encoding UGTs 85C2, EUGT11 and/or 91D2e, 76G1, and rhamnose synthetase when fed steviol-19-O-glucoside, or by the expression of genes encoding UGTs EUGT11 and/or 91D2e, 76G1, and rhamnose synthetase when fed rubusoside. Typically, one or more of these genes are recombinant genes that have been transformed into a microorganism that does not naturally possess them.

Suitable EUGT11, UGT91D2, UGT74G1, UGT76G1 and UGT85C2 polypeptides include the functional UGT polypeptides discussed herein. Rhamnose synthetase provides increased amounts of the UDP-rhamnose donor for rhamnosylation of the steviol compound acceptor. Suitable rhamnose synthetases include those made by *Arabidopsis thaliana*, such as the product of the *A. thaliana* RHM2 gene.

In some embodiments, a UGT79B3 polypeptide is substituted for a UGT91D2 polypeptide. Suitable UGT79B3 polypeptides include those made by *Arabidopsis thaliana*, which are capable of rhamnosylation of steviol 13-O-monoside in vitro. *A. thaliana* UGT79B3 can rhamnosylate glucosylated compounds to form 1,2-rhamnosides. The amino acid sequence of an *Arabidopsis thaliana* UGT79B3 is set forth in SEQ ID NO:150. The nucleotide sequence encoding the amino acid sequence of SEQ ID NO:150 is set forth in SEQ ID NO:151.

In some embodiments rebaudioside C can be produced using in vitro methods while supplying the appropriate UDP-sugar and/or a cell-free system for regeneration of UDP-sugars. See, for example, "An integrated cell-free metabolic platform for protein production and synthetic biology" by Jewett M C, Calhoun K A, Voloshin A, Wuu J J and Swartz J R in *Molecular Systems Biology,* 4, article 220 (2008); Masada S et al. *FEBS Letters*, Vol. 581, 2562-2566 (2007). In some embodiments, sucrose and a sucrose synthase may be provided in the reaction vessel in order to regenerate UDP-glucose from UDP during the glycosylation reactions. See FIG. 11. The sucrose synthase can be from any suitable organism. For example, a sucrose synthase coding sequence from *Arabidopsis thaliana, Stevia rebaudiana*, or *Coffea arabica* can be cloned into an expression plasmid under control of a suitable promoter, and expressed in a host (e.g., a microorganism or a plant). In some embodiments a RHM2 enzyme (Rhamnose synthase) may also be provided, with NADPH, to generate UDP-rhamnose from UDP-glucose.

Reactions may be carried out together, or stepwise. For instance, rebaudioside C may be produced from rubusoside with the addition of stoichiometric amounts of UDP-rhamnose and EUGT11, followed by addition of UGT76G1 and an excess or stoichiometric supply of UDP-glucose. In some embodiments, phosphatases are used to remove secondary products and improve the reaction yields. UGTs and other enzymes for in vitro reactions may be provided in soluble forms or immobilized forms. In some embodiments, rebaudioside C, Dulcoside A, or other steviol rhamnosides can be produced using whole cells as discussed above. The cells can contain one recombinant UGT or multiple recombinant UGTs. For example, the cells can contain UGT 76G1 and EUGT11 such that mixtures of stevioside and RebA are efficiently converted to RebD. In some embodiments, the whole cells are the host cells described in section III A.

In other embodiments, the recombinant host expresses one or more genes involved in steviol biosynthesis, e.g., a CDPS gene, a KS gene, a KO gene and/or a KAH gene. Thus, for example, a microorganism containing a CDPS gene, a KS gene, a KO gene and a KAH gene, in addition to a UGT85C2, a UGT74G1, a EUGT11 gene, optionally a UGT91D2e gene, and a UGT76G1 gene, is capable of producing rebaudioside C without the necessity for including steviol in the culture media. In addition, the recombinant host typically expresses an endogenous or a recombinant gene encoding a rhamnose synthetase. Such a gene is useful in order to provide increased amounts of the UDP-rhamnose donor for rhamnosylation of the steviol compound acceptor. Suitable rhamnose synthetases include those made by *Arabidopsis thaliana*, such as the product of the *A. thaliana* RHM2 gene.

One with skill in the art will recognize that by modulating relative expression levels of different UGT genes as well as modulating the availability of UDP-rhamnose, a recombinant host can be tailored to specifically produce steviol and steviol glycoside products in a desired proportion. Transcriptional regulation of steviol biosynthesis genes, and steviol glycoside biosynthesis genes can be achieved by a combination of transcriptional activation and repression using techniques known to those in the art. For in vitro reactions, one with skill in the art will recognize that addition of different levels of UGT enzymes in combination or under conditions which impact the relative activities of the different UGTS in combination will direct synthesis towards a desired proportion of each steviol glycoside.

In some embodiments, the recombinant host further contains and expresses a recombinant GGPPS gene in order to provide increased levels of the diterpene precursor geranylgeranyl diphosphate, for increased flux through the rebaudioside A biosynthetic pathway. In some embodiments, the recombinant host further contains a construct to silence or reduce the expression of non-steviol pathways consuming geranylgeranyl diphosphate, ent-Kaurenoic acid or farnesyl pyrophosphate, thereby providing increased flux through the steviol and steviol glycosides biosynthetic pathways. For example, flux to sterol production pathways such as ergosterol may be reduced by downregulation of the ERG9 gene. See, the ERG9 section below and Examples 24-25. In cells that produce gibberellins, gibberellin synthesis may be downregulated to increase flux of ent-kaurenoic acid to steviol. In carotenoid-producing organisms, flux to steviol may be increased by downregulation of one or more carotenoid biosynthetic genes.

In some embodiments, the recombinant host further contains and expresses recombinant genes involved in diterpene biosynthesis or production of terpenoid precursors, e.g., genes in the MEP or MEV pathway, have reduced phosphatase activity, and/or express a SUS as discussed herein.

In some embodiments, a recombinant host such as a microorganism produces steviol glycoside compositions that have greater than at least 15% rebaudioside C of the total steviol glycosides, e.g., at least 20% rebaudioside C, 30-40% rebaudioside C, 40-50% rebaudioside C, 50-60% rebaudioside C, 60-70% rebaudioside C, 70-80% rebaudioside C, 80-90% rebaudioside C. In some embodiments, a recombinant host such as a microorganism produces steviol glycoside compositions that have at least 90% rebaudioside C, e.g., 90-99% rebaudioside C. Other steviol glycosides present may include those depicted in FIGS. 2A and B such as steviol monosides, steviol glucobiosides, steviol rhamnobiosides, rebaudioside A, and Dulcoside A. In some embodiments, the rebaudioside C-enriched composition produced by the host can be further purified and the rebaudioside C or Dulcoside A so purified may then be mixed with other steviol glycosides, flavors, or sweeteners to obtain a desired flavor system or sweetening composition. For instance, a rebaudioside C-enriched composition produced by a recombinant microorganism can be combined with a rebaudioside A, F, or D-enriched composition produced by a different recombinant microorganism, with rebaudioside A, F, or D purified from a *Stevia* extract, or with rebaudioside A, F, or D produced in vitro.

B. 4 Rebaudioside F Biosynthesis Polypeptides

The biosynthesis of rebaudioside F involves glucosylation and xylosylation of the aglycone steviol. Specifically, rebaudioside F can be formed by glucosylation of the 13-OH of steviol which forms steviol-13-O-glucoside, xylosylation of the C-2' of the 13-O-glucose of steviol-13-O-glucoside which forms steviol-1,2-xylobioside, glucosylation of the C-19 carboxyl of the 1,2-xylobioside to form 1,2-stevioxyloside, and glucosylation of the C-3' of the C-13-O-glucose of 1,2-stevioxyloside to form rebaudioside F. The order in which each glycosylation reaction occurs can vary. See FIG. 2D.

It has been discovered that conversion of steviol to rebaudioside F in a recombinant host can be accomplished by the expression of genes encoding the following functional UGTs: 85C2, EUGT11 and/or 91D2e, 74G1, and 76G1, along with endogenous or recombinantly expressed UDP-glucose dehydrogenase and UDP-glucuronic acid decarboxylase. Thus, a recombinant microorganism expressing these four or five UGTs along with endogenous or recombinant UDP-glucose dehydrogenase and UDP-glucuronic acid decarboxylase can make rebaudioside F when fed steviol in the medium. Alternatively, a recombinant microorganism expressing two functional UGTs, EUGT11 or 91D2e, and 76G1, can make rebaudioside F when fed rubusoside in the medium. As another alternative, a recombinant microorganism expressing a functional UGT 76G1 can make rebaudioside F when fed 1,2 steviorhamnoside. As another alternative, a recombinant microorganism expressing 74G1, EUGT11 and/or 91D2e, 76G1, and can make rebaudioside F when fed the monoside, steviol-13-O-glucoside, in the medium. Similarly, conversion of steviol-19-O-glucoside to rebaudioside F in a recombinant microorganism can be accomplished by the expression of genes encoding UGTs 85C2, EUGT11 and/or 91D2e, and 76G1, when fed steviol-19-O-glucoside. Typically, one or more of these genes are recombinant genes that have been transformed into a host that does not naturally possess them.

Suitable EUGT11, UGT91D2, UGT74G1, UGT76G1 and UGT85C2 polypeptides include the functional UGT polypeptides discussed herein. In some embodiments, a UGT79B3 polypeptide is substituted for a UGT91, as discussed above. UDP-glucose dehydrogenase and UDP-glucuronic acid decarboxylase provide increased amounts of the UDP-xylose donor for xylosylation of the steviol compound acceptor. Suitable UDP-glucose dehydrogenases and UDP-glucuronic acid decarboxylases include those made by *Arabidopsis thaliana* or *Cryptococcus neoformans*. For example, suitable UDP-glucose dehydrogenase and UDP-glucuronic acid decarboxylases polypeptides can be encoded by the *A. thaliana* UGD1 gene and UXS3 gene, respectively. See, Oka and Jigami, *FEBS J.* 273:2645-2657 (2006).

In some embodiments rebaudioside F can be produced using in vitro methods while supplying the appropriate UDP-sugar and/or a cell-free system for regeneration of UDP-sugars. See, for example, Jewett M C, et al. *Molecular Systems Biology, Vol.* 4, article 220 (2008); Masada S et al. *FEBS Letters, Vol.* 581, 2562-2566 (2007). In some embodiments, sucrose and a sucrose synthase are provided in the reaction vessel in order to regenerate UDP-glucose from UDP during the glycosylation reactions. See FIG. 11. The sucrose synthase can be from any suitable organism. For example, a sucrose synthase coding sequence from *Arabidopsis thaliana, Stevia rebaudiana*, or *Coffea arabica* can be cloned into an expression plasmid under control of a suitable promoter, and expressed in a host, e.g., a microorganism or a plant. In some embodiments, UDP-xylose can be produced from UDP-glucose by supplying suitable enzymes, for example, the *Arabidopsis thaliana* UGD1 (UDP-glucose dehydrogenase) and UXS3 (UDP-glucuronic acid decarboxylase) enzymes along with NAD+ cofactor.

Reactions may be carried out together, or stepwise. For instance, rebaudioside F may be produced from rubusoside with the addition of stoichiometric amounts of UDP-xylose and EUGT11, followed by addition of UGT76G1 and an excess or stoichiometric supply of UDP-glucose. In some embodiments, phosphatases are used to remove secondary products and improve the reaction yields. UGTs and other enzymes for in vitro reactions may be provided in soluble forms or immobilized forms. In some embodiments, rebaudioside F or other steviol xylosides can be produced using whole cells as discussed above. For example, the cells may contain UGT 76G1 and EUGT11 such that mixtures of stevioside and RebA are efficiently converted to RebD. In some embodiments, the whole cells are the host cells described in section III A.

In other embodiments, the recombinant host expresses one or more genes involved in steviol biosynthesis, e.g., a CDPS gene, a KS gene, a KO gene and/or a KAH gene. Thus, for example, a microorganism containing a CDPS gene, a KS gene, a KO gene and a KAH gene, in addition to a EUGT11, UGT85C2, a UGT74G1, an optional UGT91D2 gene, and a UGT76G1 gene, is capable of producing rebaudioside F without the necessity for including steviol in the culture media. In addition, the recombinant host typically expresses an endogenous or a recombinant gene encoding a UDP-glucose dehydrogenase and a UDP-glucuronic acid decarboxylase. Such genes are useful in order to provide increased amounts of the UDP-xylose donor for xylosylation of the steviol compound acceptor. Suitable UDP-glucose dehydrogenases and UDP-glucuronic acid decarboxylases include those made by *Arabidopsis thaliana* or *Cryptococcus neoformans*. For example, suitable UDP-glucose dehydrogenase and UDP-glucuronic acid decarboxylases polypeptides can be encoded by the *A. thaliana* UGD1 gene and UXS3 gene, respectively. See, Oka and Jigami, *FEBS J.* 273:2645-2657 (2006).

One with skill in the art will recognize that by modulating relative expression levels of different UGT genes as well as modulating the availability of UDP-xylose, a recombinant microorganism can be tailored to specifically produce steviol and steviol glycoside products in a desired proportion. Transcriptional regulation of steviol biosynthesis genes can be achieved by a combination of transcriptional activation and repression using techniques known to those in the art. For in vitro reactions, one with skill in the art will recognize that addition of different levels of UGT enzymes in combination or under conditions which impact the relative activities of the different UGTS in combination will direct synthesis towards a desired proportion of each steviol glycosides.

In some embodiments, the recombinant host further contains and expresses a recombinant GGPPS gene in order to provide increased levels of the diterpene precursor geranylgeranyl diphosphate, for increased flux through the steviol biosynthetic pathway. In some embodiments, the recombinant host further contains a construct to silence the expression of non-steviol pathways consuming geranylgeranyl diphosphate, ent-Kaurenoic acid or farnesyl pyrophosphate, thereby providing increased flux through the steviol and steviol glycosides biosynthetic pathways. For example, flux to sterol production pathways such as ergosterol may be reduced by downregulation of the ERG9 gene. See, the ERG9 section below and Examples 24-25. In cells that produce gibberellins, gibberellin synthesis may be downregulated to increase flux of ent-kaurenoic acid to steviol. In carotenoid-producing organisms, flux to steviol may be increased by downregulation of one or more carotenoid biosynthetic genes. In some embodiments, the recombinant host further contains and expresses recombinant genes involved in diterpene biosynthesis, e.g., genes in the MEP pathway discussed below.

In some embodiments, a recombinant host such as a microorganism produces rebaudioside F-enriched steviol glycoside compositions that have greater than at least 4% rebaudioside F by weight total steviol glycosides, e.g., at least 5% rebaudioside F, at least 6% of rebaudioside F, 10-20% rebaudioside F, 20-30% rebaudioside F, 30-40% rebaudioside F, 40-50% rebaudioside F, 50-60% rebaudioside F, 60-70% rebaudioside F, 70-80% rebaudioside F. In some embodiments, a recombinant host such as a microorganism produces steviol glycoside compositions that have at least 90% rebaudioside F, e.g., 90-99% rebaudioside F. Other steviol glycosides present may include those depicted in FIGS. 2A and D such as steviol monosides, steviol glucobiosides, steviol xylobiosides, rebaudioside A, stevioxyloside, rubusoside and stevioside. In some embodiments, the rebaudioside F-enriched composition produced by the host can be mixed with other steviol glycosides, flavors, or sweeteners to obtain a desired flavor system or sweetening composition. For instance, a rebaudioside F-enriched composition produced by a recombinant microorganism can be combined with a rebaudioside A, C, or D-enriched composition produced by a different recombinant microorganism, with rebaudioside A, C, or D purified from a *Stevia* extract, or with rebaudioside A, C, or D produced in vitro.

C. Other Polypeptides

Genes for additional polypeptides whose expression facilitates more efficient or larger scale production of steviol or a steviol glycoside can also be introduced into a recombinant host. For example, a recombinant microorganism, plant, or plant cell can also contain one or more genes encoding a geranylgeranyl diphosphate synthase (GGPPS, also referred to as GGDPS). As another example, the recombinant host can contain one or more genes encoding a rhamnose synthetase, or one or more genes encoding a UDP-glucose dehydrogenase and/or a UDP-glucuronic acid decarboxylase. As another example, a recombinant host can also contain one or more genes encoding a cytochrome P450 reductase (CPR). Expression of a recombinant CPR facilitates the cycling of NADP+ to regenerate NADPH, which is utilized as a cofactor for terpenoid biosynthesis. Other methods can be used to regenerate NADHP levels as well. In circumstances where NADPH becomes limiting; strains can be further modified to include exogenous transhydrogenase genes. See, e.g., Sauer et al., *J. Biol. Chem.* 279: 6613-6619 (2004). Other methods are known to those with skill in the art to reduce or otherwise modify the ratio of NADH/NADPH such that the desired cofactor level is increased.

As another example, the recombinant host can contain one or more genes encoding one or more enzymes in the MEP pathway or the mevalonate pathway. Such genes are useful because they can increase the flux of carbon into the diterpene biosynthesis pathway, producing geranylgeranyl diphosphate from isopentenyl diphosphate and dimethylallyl diphosphate generated by the pathway. The geranylgeranyl diphosphate so produced can be directed towards steviol and steviol glycoside biosynthesis due to expression of steviol biosynthesis polypeptides and steviol glycoside biosynthesis polypeptides.

As another example the recombinant host can contain one or more genes encoding a sucrose synthase, and additionally can contain sucrose uptake genes if desired. The sucrose synthase reaction can be used to increase the UDP-glucose pool in a fermentation host, or in a whole cell bioconversion process. This regenerates UDP-glucose from UDP produced during glycosylation and sucrose, allowing for efficient glycosylation. In some organisms, disruption of the endogenous invertase is advantageous to prevent degradation of sucrose. For example, the *S. cerevisiae* SUC2 invertase may be disrupted. The sucrose synthase (SUS) can be from any suitable organism. For example, a sucrose synthase coding sequence from, without limitation, *Arabidopsis thaliana, Stevia rebaudiana*, or *Coffea arabica* can be cloned into an expression plasmid under control of a suitable promoter, and expressed in a host (e.g., a microorganism or a plant). The sucrose synthase can be expressed in such a strain in combination with a sucrose transporter (e.g., the *A. thaliana* SUC1 transporter or a functional homolog thereof) and one or more UGTs (e.g., one or more of UGT85C2, UGT74G1, UGT76G1, and UGT91D2e, EUGT11 or functional homologs thereof). Culturing the host in a medium that contains sucrose can promote production of UDP-glucose, as well as one or more glucosides (e.g., steviol glycosides).

In addition, a recombinant host can have reduced phosphatase activity as discussed herein.

C. 1 MEP Biosynthesis Polypeptides

In some embodiments, a recombinant host contains one or more genes encoding enzymes involved in the methylerythritol 4-phosphate (MEP) pathway for isoprenoid biosynthesis. Enzymes in the MEP pathway include deoxyxylulose 5-phosphate synthase (DXS), D-1-deoxyxylulose 5-phosphate reductoisomerase (DXR), 4-diphosphocytidyl-2-C-methyl-D-erythritol synthase (CMS), 4-diphosphocytidyl-2-C-methyl-D-erythritol kinase (CMK), 4-diphosphocytidyl-2-C-methyl-D-erythritol 2,4-cyclodiphosphate synthase (MCS), 1-hydroxy-2-methyl-2(E)-butenyl 4-diphosphate synthase (HDS) and 1-hydroxy-2-methyl-2(E)-butenyl 4-diphosphate reductase (HDR). One or more DXS genes, DXR genes, CMS genes, CMK genes, MCS genes, HDS genes and/or HDR genes can be incorporated into a recombinant microorganism. See, Rodríguez-Concepción and Boronat, *Plant Phys.* 130: 1079-1089 (2002).

Suitable genes encoding DXS, DXR, CMS, CMK, MCS, HDS and/or HDR polypeptides include those made by *E. coli, Arabidopsis thaliana* and *Synechococcus leopoliensis*. Nucleotide sequences encoding DXR polypeptides are described, for example, in U.S. Pat. No. 7,335,815.

C. 2 Mevalonate Biosynthesis Polypeptides

In some embodiments, a recombinant host contains one or more genes encoding enzymes involved in the mevalonate pathway for isoprenoid biosynthesis. Genes suitable for transformation into a host encode enzymes in the mevalonate pathway such as a truncated 3-hydroxy-3-methyl-glutaryl (HMG)-CoA reductase (tHMG), and/or a gene encoding a mevalonate kinase (MK), and/or a gene encoding a phosphomevalonate kinase (PMK), and/or a gene encoding a mevalonate pyrophosphate decarboxylase (MPPD). Thus, one or more HMG-CoA reductase genes, MK genes, PMK genes, and/or MPPD genes can be incorporated into a recombinant host such as a microorganism.

Suitable genes encoding mevalonate pathway polypeptides are known. For example, suitable polypeptides include those made by *E. coli, Paracoccus denitrificans, Saccharomyces cerevisiae, Arabidopsis thaliana, Kitasatospora griseola, Homo sapiens, Drosophila melanogaster, Gallus gallus, Streptomyces* sp. KO-3988, *Nicotiana attenuata, Kitasatospora griseola, Hevea brasiliensis, Enterococcus faecium* and *Haematococcus pluvialis*. See, e.g., Table 8 and U.S. Pat. Nos. 7,183,089, 5,460,949, and 5,306,862.

TABLE 8

Sources of HMG CoA Reductases and other Mevalonate Genes

| Accession# | Organism | Enzyme | Size (nt) | Gene name | SEQ ID (codon optimized) | SEQ ID (protein) |
|---|---|---|---|---|---|---|
| XM_001467423 | *Leishmania infantum* | Acetyl-CoA C-acetyltransferase | 1323 | MEV-4 | 103 | 104 |
| YML075C | *Saccharomyces cerevisiae* | Truncated HMG (tHMG1) | 1584 | tHMG1 | 105 | 106 |
| EU263989 | *Ganoderma lucidum* | 3-HMG-CoA reductase | 3681 | MEV-11 | 107 | 108 |
| BC153262 | *Bos taurus* | 3-HMG-CoA reductase | 2667 | MEV-12 | 109 | 110 |
| AAD47596 | *Artemisia annua* | 3-HMG-CoA reductase | 1704 | MEV-13 | 111 | 112 |
| AAB62280 | *Trypanosoma cruzi* | 3-HMG-CoA reductase | 1308 | MEV-14 | 113 | 114 |
| CAG41604 | *Staph aureus* | 3-HMG-CoA reductase | 1281 | MEV-15 | 115 | 116 |
| DNA2.0 sequence | *Archaeoglobus fulgidus* | 3-HMG-CoA reductase | 1311 | HMG reductase | 117 | 118 |

TABLE 8-continued

| Sources of HMG CoA Reductases and other Mevalonate Genes | | | | | | |
|---|---|---|---|---|---|---|
| Accession# | Organism | Enzyme | Size (nt) | Gene name | SEQ ID (codon optimized) | SEQ ID (protein) |
| DNA2.0 sequence | *Pseudomonas mevalonii* | 3-HMG-CoA reductase | 1287 | HMG reductase | 119 | 120 |

C.3 Sucrose Synthase Polypeptides

Figure 11:
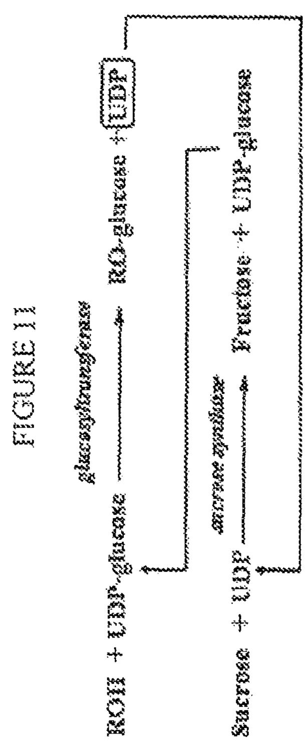
FIG. 11 is a schematic representation of UDP-glucose regeneration for the biosynthesis of steviol glycosides. SUS=sucrose synthase; Steviol=steviol or steviol glycoside substrate; UGT=UDP glycosyl transferase.

Sucrose synthase (SUS) can be used as a tool for generating UDP-sugar. SUS (EC 2.4.1.13) catalyzes the formation of UDP-glucose and fructose from sucrose and UDP (FIG. 11). UDP generated by the reaction of UGTs thus can be converted into UDP-glucose in the presence of sucrose. See, e.g., Chen et al. (2001) *J. Am. Chem. Soc.* 123:8866-8867; Shao et al. (2003) *Appl. Env. Microbiol.* 69:5238-5242; Masada et al. (2007) *FEBS Lett.* 581:2562-2566; and Son et al. (2009) *J. Microbiol. Biotechnol.* 19:709-712.

Sucrose synthases can be used to generate UDP-glucose and remove UDP, facilitating efficient glycosylation of compounds in various systems. For example, yeast deficient in the ability to utilize sucrose can be made to grow on sucrose by introducing a sucrose transporter and a SUS. For example, *Saccharomyces cerevisiae* does not have an efficient sucrose uptake system, and relies on extracellular SUC2 to utilize sucrose. The combination of disrupting the endogenous *S. cerevisiae* SUC2 invertase and expressing recombinant SUS resulted in a yeast strain that was able to metabolize intracellular but not extracellular sucrose (Riesmeier et al. ((1992) *EMBO J.* 11:4705-4713). The strain was used to isolate sucrose transporters by transformation with a cDNA expression library and selection of transformants that had gained the ability to take up sucrose.

As described herein, the combined expression of recombinant sucrose synthase and a sucrose transporter in vivo can lead to increased UDP-glucose availability and removal of unwanted UDP. For example, functional expression of a recombinant sucrose synthase, a sucrose transporter, and a glycosyltransferase, in combination with knockout of the natural sucrose degradation system (SUC2 in the case of *S. cerevisiae*) can be used to generate a cell that is capable of producing increased amounts of glycosylated compounds such as steviol glycosides. This higher glycosylation capability is due to at least (a) a higher capacity for producing UDP-glucose in a more energy efficient manner, and (b) removal of UDP from growth medium, as UDP can inhibit glycosylation reactions.

The sucrose synthase can be from any suitable organism. For example, a sucrose synthase coding sequence from, without limitation, *Arabidopsis thaliana, Stevia rebaudiana*, or *Coffea arabica* (see, e.g., FIGS. 19A-19C, SEQ ID NOs:178, 179, and 180) can be cloned into an expression plasmid under control of a suitable promoter, and expressed in a host (e.g., a microorganism or a plant). As described in the Examples herein, a SUS coding sequence may be expressed in a SUC2 (sucrose hydrolyzing enzyme) deficient *S. cerevisiae* strain, so as to avoid degradation of extracellular sucrose by the yeast. The sucrose synthase can be expressed in such a strain in combination with a sucrose transporter (e.g., the *A. thaliana* SUC1 transporter or a functional homolog thereof) and one or more UGTs (e.g., one or more of UGT85C2, UGT74G1, UGT76G1, EUGT11, and UGT91D2e, or functional homologs thereof). Culturing the host in a medium that contains sucrose can promote production of UDP-glucose, as well as one or more glucosides (e.g., steviol glucoside). It is to be noted that in some cases, a sucrose synthase and a sucrose transporter can be expressed along with a UGT in a host cell that also is recombinant for production of a particular compound (e.g., steviol).

C. 4 Modulation of ERG9 activity

It is an object of the disclosure to produce terpenoids based on the concept of increasing the accumulation of terpenoid precursors of the squalene pathway. Non-limiting examples of terpenoids include Hemiterpenoids, 1 isoprene unit (5 carbons); Monoterpenoids, 2 isoprene units (10C); Sesquiterpenoids, 3 isoprene units (15C); Diterpenoids, 4 isoprene units (20C) (e.g. ginkgolides); Triterpenoids, 6 isoprene units (30C); Tetraterpenoids, 8 isoprene units (40C) (e.g. carotenoids); and polyterpenoid with a larger number of isoprene units.

Hemiterpenoids include isoprene, prenol and isovaleric acid. Monoterpenoids include Geranyl pyrophosphate, Eucalyptol, Limonene and Pinene. Sesquiterpenoids include Farnesyl pyrophosphate, Artemisinin and Bisabolol. Diterpenoids include Geranylgeranyl pyrophosphate, steviol, Retinol, Retinal, Phytol, Taxol, Forskolin and Aphidicolin. Triterpenoids include Squalene and Lanosterol. Tetraterpenoids include Lycopene and Carotene.

Terpenes are hydrocarbons resulting from the combination of several isoprene units. Terpenoids can be thought of as terpene derivatives. The term terpene is sometimes used broadly to include the terpenoids. Just like terpenes, the terpenoids can be classified according to the number of isoprene units used. The present invention is focussed on terpenoids and in particular terpenoids derived through the squalene pathway from the precursors Farnesyl-pyrophosphate (FPP), Isopentenyl-pyrophosphate (IPP), Dimethylallyl-pyrophosphate (DMAPP), Geranyl-pyrophosphate (GPP) and/or Geranylgeranyl-pyrophosphate (GGPP).

By terpenoids is understood terpenoids of the Hemiterpenoid class such as but not limited to isoprene, prenol and isovaleric acid; terpenoids of the Monoterpenoid class such as but not limited to geranyl pyrophosphate, eucalyptol, limonene and pinene; terpenoids of the Sesquiterpenoids class such as but not limited to farnesyl pyrophosphate, artemisinin and bisabolol; terpenoids of the diterpenoid class such as but not limited to geranylgeranyl pyrophosphate, steviol, retinol, retinal, phytol, taxol, forskolin and aphidicolin; terpenoids of the Triterpenoid class such as but not limited to lanosterol; terpenoids of the Tetraterpenoid class such as but not limited to lycopene and carotene.

In one embodiment the invention relates to production of terpenoids, which are biosynthesized from Geranylgeranyl-pyrophosphate (GGPP). In particular such terpenoids may be steviol.

In one embodiment the invention relates to production of terpenoids, which are biosynthesized from Geranylgeranyl-pyrophosphate (GGPP). In particular such terpenoids may be steviol.

The Cell

Figures 22, 23:
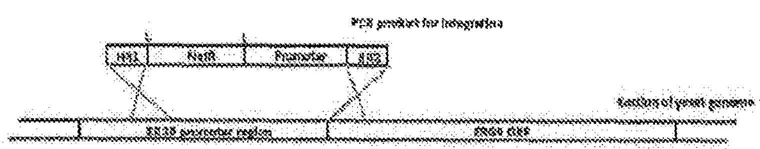
FIG. 22 is a schematic of the PCR product containing two regions, HR1 and HR2, which are homologous to parts of the genome sequence within the ERG9 promoter or 5' end of the ERG9 open reading frame (ORF), respectively. Also, on the PCR product is an antibiotic marker, NatR, which can be embedded between two Lox sites (L) for subsequent excision with Cre recombinase. The PCR product further can include a promoter, such as either the wild type ScKex2, wild type ScCyc1, and the promoter further can include a heterologous insert such as a hairpin (SEQ ID NO: 181-184) at its 3'-end (See FIG. 23).
FIG. 23 is a schematic of promoter and ORF with a hairpin stemloop immediately upstream of the translation startsite (arrow) and an alignment of a portion of the wild-type *S. cerevisiae* Cyc1 promoter sequence and initial ATG of the ERG9 OPR without a heterologous insert (SEQ ID NO:187) and with four different heterologous inserts (SEQ ID NOs. 188-191). 75% refers to construct comprising the ScCyc1 promoter followed by SEQ ID NO: 184 (SEQ ID NO:191); 50% refers to construct comprising the ScCyc1 promoter followed by SEQ ID NO: 183 (SEQ ID NO:190); 20% refers to construct comprising the ScCyc1 promoter followed by SEQ ID NO: 182 (SEQ ID NO:189); 5% refers to construct comprising the ScCyc1 promoter followed by SEQ ID NO: 181 (SEQ ID NO:188).

The present invention relates to a cell, such as any of the hosts described in section III, modified to comprise the construct depicted in FIG. 22. Accordingly, in a main aspect, the present invention relates to a cell comprising a nucleic acid, said nucleic acid comprising i) a promoter sequence operably linked to ii) a heterologous insert sequence operably linked to iii) an open reading frame operably linked to iv) a transcription termination signal, wherein the heterologous insert sequence has the general formula (I):

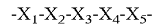

$-X_1-X_2-X_3-X_4-X_5-$ wherein $X_2$ comprises at least 4 consecutive nucleotides being complementary to, and forms a hairpin secondary structure element with at least 4 consecutive nucleotides of $X_4$, and wherein $X_3$ is optional and if present comprises nucleotides involved in forming a hairpin loop between $X_2$ and $X_4$, and wherein $X_1$ and $X_5$ individually and optionally comprise one or more nucleotides, and wherein the open reading frame upon expression encodes a squalene synthase (EC 2.5.1.21), e.g., a polypeptide sequence having at least 70% identity to a squalene synthase (EC 2.5.1.21) or a biologically active fragment thereof, said fragment having at least 70% sequence identity to said squalene synthase in a range of overlap of at least 100 amino acids.

In addition to above mentioned nucleic acid comprising a heterologous insert sequence, the cell may also comprise one or more additional heterologous nucleic acid sequences (e.g., nucleic acids encoding any of the steviol and steviol glycoside biosynthesis polypeptides of section I). In one preferred embodiment the cell comprises a heterologous nucleic acid encoding GGPPS operably linked to a nucleic acid sequence directing expression of GGPPS in said cell.

Heterologous Insert Sequence

The heterologous insert sequence can adapt the secondary structure element of a hairpin with a hairpin loop. The hairpin part comprises sections $X_2$ and $X_4$ which are complementary and hybridize to one another. Sections $X_2$ and $X_4$ flank section $X_3$, which comprises nucleotides that form a loop—the hairpin loop. The term complementary is understood by the person skilled in the art as meaning two sequences compared to each other, nucleotide by nucleotide counting from the 5' end to the 3' end, or vice versa.

The heterologous insert sequence is long enough to allow a hairpin to be completed, but short enough to allow limited translation of an ORF that is present in-frame and immediately 3' to the heterologous insert sequence. Thus, in one embodiment, the heterologous insert sequence comprises 10-50 nucleotides, preferably 10-30 nucleotides, more preferably 15-25 nucleotides, more preferably 17-22 nucleotides, more preferably 18-21 nucleotides, more preferably 18-20 nucleotides, more preferably 19 nucleotides.

$X_2$ and $X_4$ may individually consist of any suitable number of nucleotides, so long as a consecutive sequence of at least 4 nucleotides of $X_2$ is complementary to a consecutive sequence of at least 4 nucleotides of $X_4$. In a preferred embodiment $X_2$ and $X_4$ consist of the same number of nucleotides.

$X_2$ may for example consist of in the range of 4 to 25, such as in the range of 4 to 20, for example of in the range of 4 to 15, such as in the range of 6 to 12, for example in the range of 8 to 12, such as in the range of 9 to 11 nucleotides.

$X_4$ may for example consist of in the range of 4 to 25, such as in the range of 4 to 20, for example of in the range of 4 to 15, such as in the range of 6 to 12, for example in the range of 8 to 12, such as in the range of 9 to 11 nucleotides.

In one preferred embodiment, $X_2$ consists of a nucleotide sequence, which is complementary to the nucleotide sequence of $X_4$, i.e. it is preferred that all nucleotides of $X_2$ are complementary to the nucleotide sequence of $X_4$.

In one preferred embodiment $X_4$ consists of a nucleotide sequence, which is complementary to the nucleotide sequence of $X_2$, i.e. it is preferred that all nucleotides of $X_4$ are complementary to the nucleotide sequence of $X_2$. Very preferably, $X_2$ and $X_4$ consists of the same number of nucleotides, wherein $X_2$ is complementary to $X_4$ over the entire length of $X_2$ and $X_4$.

$X_3$ may be absent, i.e., $X_3$ may consist of zero nucleotides. It is also possible that $X_3$ consists of in the range of 1 to 5, such as in the range of 1 to 3 nucleotides.

$X_1$ may be absent, i.e., $X_1$ may consist of zero nucleotides. It is also possible that $X_1$ consists of in the range of 1 to 25, such as in the range of 1 to 20, for example in the range of 1 to 15, such as in the range of 1 to 10, for example in the range of 1 to 5, such as in the range of 1 to 3 nucleotides.

$X_5$ may be absent, i.e., $X_5$ may consist of zero nucleotides. It is also possible that $X_5$ may consist of in the range 1 to 5, such as in the range of 1 to 3 nucleotides.

The sequence may be any suitable sequence fulfilling the requirements defined herein above. Thus, the heterologous insert sequence may comprise a sequence selected from the group consisting of SEQ ID NO: 181, SEQ ID NO:182, SEQ ID NO:183, and SEQ ID NO:184. In a preferred embodiment the insert sequence is selected from the group consisting of SEQ ID NO: 181, SEQ ID NO:182, SEQ ID NO:183, and SEQ ID NO:184.

Squalene Synthase

Squalene synthase (SQS) is the first committed enzyme of the biosynthesis pathway that leads to the production of sterols. It catalyzes the synthesis of squalene from farnesyl pyrophosphate via the intermediate presqualene pyrophosphate. This enzyme is a critical branch point enzyme in the biosynthesis of terpenoids/isoprenoids and is thought to regulate the flux of isoprene intermediates through the sterol pathway. The enzyme is sometimes referred to as farnesyl-diphosphate farnesyltransferase (FDFT1).

The mechanism of SQS is to convert two units of farnesyl pyrophosphate into squalene.

SQS is considered to be an enzyme of eukaryotes or advanced organisms, although at least one prokaryote has been shown to possess a functionally similar enzyme.

In terms of structure and mechanics, squalene synthase most closely resembles phytoene syntase, which serves a similar role in many plants in the elaboration of phytoene, a precursor of many carotenoid compounds.

A high level of sequence identity indicates likelihood that the first sequence is derived from the second sequence. Amino acid sequence identity requires identical amino acid sequences between two aligned sequences. Thus, a candidate sequence sharing 70% amino acid identity with a reference sequence requires that, following alignment, 70% of the amino acids in the candidate sequence are identical to the corresponding amino acids in the reference sequence. Identity may be determined by aid of computer analysis, such as, without limitations, the ClustalW computer alignment program as described in section D. Using this program with its default settings, the mature (bioactive) part of a query and a reference polypeptide are aligned. The number of fully conserved residues are counted and divided by the length of the reference polypeptide. The ClustalW algorithm may similarly be used to align nucleotide sequences. Sequence identities may be calculated in a similar way as indicated for amino acid sequences.

In one important embodiment, the cell of the present invention comprises a nucleic acid sequence coding, as defined herein, upon expression for a squalene synthase wherein the squalene synthase is at least 75%, such as at least 76%, such as at least 77%, such as at least 78%, such as at least 79%, such as at least 80%, such as at least 81%, such as at least 82%, such as at least 83%, such as at least 84%, such as at least 85%, such as at least 86%, such as at least 87%, such as at least 88%, such as at least 89%, such as at least 90%, such as at least 91%, such as at least 92%, such as at least 93%, such as at least 94%, such as at least 95%, such as at least 96%, such as at least 97%, such as at least 98%, such as at least 99%, such as at least 99.5%, such as at least 99.6%, such as at least 99.7%, such as at least 99.8%, such as at least 99.9%, such as 100% identical to a squalene synthase wherein the squalene synthase is selected from the group consisting of SEQ ID NO:192, SEQ ID NO:193, SEQ ID NO:194, SEQ ID NO:195, SEQ ID NO:196, SEQ ID NO:197, SEQ ID NO:198, SEQ ID NO:199, SEQ ID NO:200, SEQ ID NO:201, and SEQ ID NO:202.

Promoter

A promoter is a region of DNA that facilitates the transcription of a particular gene. Promoters are located near the genes they regulate, on the same strand and typically upstream (towards the 5' region of the sense strand). In order for the transcription to take place, the enzyme that synthesizes RNA, known as RNA polymerase, must attach to the DNA near a gene. Promoters contain specific DNA sequences and response elements which provide a secure initial binding site for RNA polymerase and for proteins called transcription factors that recruit RNA polymerase. These transcription factors have specific activator or repressor sequences of corresponding nucleotides that attach to specific promoters and regulate gene expressions.

In bacteria, the promoter is recognized by RNA polymerase and an associated sigma factor, which in turn are often brought to the promoter DNA by an activator protein binding to its own DNA binding site nearby. In eukaryotes the process is more complicated, and at least seven different factors are necessary for the binding of an RNA polymerase II to the promoter. Promoters represent critical elements that can work in concert with other regulatory regions (enhancers, silencers, boundary elements/insulators) to direct the level of transcription of a given gene.

As promoters are normally immediately adjacent to the open reading frame (ORF) in question, positions in the promoter are designated relative to the transcriptional start site, where transcription of RNA begins for a particular gene (i.e., positions upstream are negative numbers counting back from −1, for example −100 is a position 100 base pairs upstream).

Promoter Elements

- Core promoter—the minimal portion of the promoter required to properly initiate transcription
- Transcription Start Site (TSS)
- Approximately −35 bp upstream and/or downstream of the start site
- A binding site for RNA polymerase
  - RNA polymerase I: transcribes genes encoding ribosomal RNA
  - RNA polymerase II: transcribes genes encoding messenger RNA and certain small nuclear RNAs
  - RNA polymerase III: transcribes genes encoding tRNAs and other small RNAs
- General transcription factor binding sites
- Proximal promoter—the proximal sequence upstream of the gene that tends to contain primary regulatory elements
- Approximately −250 bp upstream of the start site
- Specific transcription factor binding sites
- Distal promoter—the distal sequence upstream of the gene that may contain additional regulatory elements, often with a weaker influence than the proximal promoter
- Anything further upstream (but not an enhancer or other regulatory region whose influence is positional/orientation independent)
- Specific transcription factor binding sites Prokaryotic Promoters In prokaryotes, the promoter consists of two short sequences at −10 and −35 positions upstream from the transcription start site. Sigma factors not only help in enhancing RNAP binding to the promoter but also help RNAP target specific genes to transcribe.

The sequence at −10 is called the Pribnow box, or the −10 element, and usually consists of the six nucleotides TATAAT. The Pribnow box is essential to start transcription in prokaryotes.

The other sequence at −35 (the −35 element) usually consists of the seven nucleotides TTGACAT. Its presence allows a very high transcription rate.

Both of the above consensus sequences, while conserved on average, are not found intact in most promoters. On average only 3 of the 6 base pairs in each consensus sequence is found in any given promoter. No promoter has been identified to date that has intact consensus sequences at both the −10 and −35; artificial promoters with complete conservation of the −10/−35 hexamers has been found to promote RNA chain initiation at very high efficiencies.

Some promoters contain a UP element (consensus sequence 5'-AAAWWTWTTTTNNNAAANNN-3; W=A or T; N=any base) centered at −50; the presence of the −35 element appears to be unimportant for transcription from the UP element-containing promoters.

Eukaryotic Promoters

Eukaryotic promoters are typically located upstream of the gene (ORF) and can have regulatory elements several kilobases (kb) away from the transcriptional start site. In eukaryotes, the transcriptional complex can cause the DNA to fold back on itself, which allows for placement of regulatory sequences far from the actual site of transcription. Many eukaryotic promoters, contain a TATA box (sequence TATAAA), which in turn binds a TATA binding protein which assists in the formation of the RNA polymerase transcriptional complex. The TATA box typically lies very close to the transcriptional start site (often within 50 bases).

The cell of the present invention comprises a nucleic acid sequence which comprises a promoter sequence. The promoter sequence is not limiting for the invention and can be any promoter suitable for the host cell of choice.

In one embodiment of the present invention the promoter is a constitutive or inducible promoter.

In a further embodiment of the invention, the promoter is selected from the group consisting of an endogenous promoter, PGK-1, GPD1, PGK1, ADH1, ADH2, PYK1, TPI1, PDC1, TEF1, TEF2, FBA1, GALL-10, CUP1, MET2, MET14, MET25, CYC1, GAL1-S, GAL1-L, TEF1, ADH1, CAG, CMV, human UbiC, RSV, EF-1alpha, SV40, Mt1, Tet-On, Tet-Off, Mo-MLV-LTR, Mx1, progesterone, RU486 and Rapamycin-inducible promoter.

Post-Transcriptional Regulation

Post-transcriptional regulation is the control of gene expression at the RNA level, therefore between the transcription and the translation of the gene.

The first instance of regulation is at transcription (transcriptional regulation) where due to the chromatin arrangement and due to the activity of transcription factors, genes are differentially transcribed.

After being produced, the stability and distribution of the different transcripts is regulated (post-transcriptional regulation) by means of RNA binding protein (RBP) that control the various steps and rates of the transcripts: events such as alternative splicing, nuclear degradation (exosome), processing, nuclear export (three alternative pathways), sequestration in DCP2-bodies for storage or degradation, and ultimately translation. These proteins achieve these events thanks to a RNA recognition motif (RRM) that binds a specific sequence or secondary structure of the transcripts, typically at the 5' and 3' UTR of the transcript.

Modulating the capping, splicing, addition of a Poly(A) tail, the sequence-specific nuclear export rates and in several contexts sequestration of the RNA transcript occurs in eukaryotes but not in prokaryotes. This modulation is a result of a protein or transcript which in turn is regulated and may have an affinity for certain sequences.

Capping

Capping changes the five prime end of the mRNA to a three prime end by 5'-5' linkage, which protects the mRNA from 5' exonuclease, which degrades foreign RNA. The cap also helps in ribosomal binding.

Splicing

Splicing removes the introns, noncoding regions that are transcribed into RNA, in order to make the mRNA able to create proteins. Cells do this by spliceosomes binding on either side of an intron, looping the intron into a circle and then cleaving it off. The two ends of the exons are then joined together.

Polyadenylation

Polyadenylation is the addition of a poly(A) tail to the 3' end, i.e. the poly(A) tail consists of multiple adenosine monophosphates. The poly-A sequence acts as a buffer to the 3' exonuclease and thus increases half-life of mRNA. In addition, a long poly(A) tail can increase translation. Thus the poly-A tail may be used to further modulate translation of the construct of the present invention, in order to arrive at the optimal translation rate.

In eukaryotes, polyadenylation is part of the process that produces mature messenger RNA (mRNA) for translation.

The poly(A) tail is also important for the nuclear export, translation, and stability of mRNA.

In one embodiment the nucleic acid sequence of the cell of the present invention, as defined herein above, further comprises a polyadenyl/polyadenylation sequence, preferably the 5' end of said polyadenyl l/polyadenylation sequence is operably linked to the 3' end of the open reading frame, such as to the open reading frame encoding squalene synthase.

RNA Editing

RNA editing is a process which results in sequence variation in the RNA molecule, and is catalyzed by enzymes. These enzymes include the Adenosine Deaminase Acting on RNA (ADAR) enzymes, which convert specific adenosine residues to inosine in an mRNA molecule by hydrolytic deamination. Three ADAR enzymes have been cloned, ADAR1, ADAR2 and ADAR3, although only the first two subtypes have been shown to have RNA editing activity. Many mRNAs are vulnerable to the effects of RNA editing, including the glutamate receptor subunits GluR2, GluR3, GluR4, GluR5 and GluR6 (which are components of the AMPA and kainate receptors), the serotonin2C receptor, the GABA-alpha3 receptor subunit, the tryptophan hydroxlase enzyme TPH2, the hepatitis delta virus and more than 16% of microRNAs. In addition to ADAR enzymes, CDAR enzymes exist and these convert cytosines in specific RNA molecules, to uracil. These enzymes are termed 'APOBEC' and have genetic loci at 22q13, a region close to the chromosomal deletion which occurs in velocardiofacial syndrome (22q11) and which is linked to psychosis. RNA editing is extensively studied in relation to infectious diseases, because the editing process alters viral function.

Post-Transcriptional Regulatory Elements

Use of a post-transcriptional regulatory elements (PRE) is often necessary to obtain vectors with sufficient performance for certain applications. Schambach et al in Gene Ther. (2006) 13(7):641-5 reports that introduction of a post-transcriptional regulatory element (PRE) of woodchuck hepatitis virus (WHV) into the 3' untranslated region of retroviral and lentiviral gene transfer vectors enhances both titer and transgene expression. The enhancing activity of the PRE depends on the precise configuration of its sequence and the context of the vector and cell into which it is introduced.

Thus use of a PRE such as a woodchuck hepatitis virus post-transcriptional regulatory elements (WPRE) may be useful in the preparation of the cell of the present invention when using a gene therapeutic approach.

Accordingly, in one embodiment the nucleic acid sequence of the cell defined herein further comprises a post-transcriptional regulatory element.

In a further embodiment, the post-transcriptional regulatory element is a Woodchuck hepatitis virus post-transcriptional regulatory element (WPRE).

Terminal Repeats

To insert genetic sequences into host DNA, viruses often use sequences of DNA that repeats up to thousands of times, so called repeats, or terminal repeats including long terminal repeats (LTR) and inverted terminal repeats (ITR), wherein said repeat sequences may be both 5' and 3' terminal repeats. ITRs aid in concatamer formation in the nucleus after the single-stranded vector DNA is converted by host cell DNA polymerase complexes into double-stranded DNA. ITR sequences may be derived from viral vectors, such as AAV, e.g. AAV2.

In one embodiment, the nucleic acid sequence or the vector of the cell defined herein comprises a 5' terminal repeat and a 3' terminal repeat.

In one embodiment said 5' and 3' terminal repeats are selected from Inverted Terminal Repeats [ITR] and Long Terminal Repeats [LTR].

In one embodiment of said 5' and 3' terminal repeats are AAV Inverted Terminal Repeats [ITR].

Geranylgeranyl Pyrophosphate Synthase

The microbial cells of the present invention may in preferred embodiments contain a heterologous nucleic acid sequence encoding Geranylgeranyl Pyrophosphate Synthase (GGPPS). See, e.g., Table 7. GGPPS is an enzyme, which catalyzes the chemical reaction that turns one farnesyl pyrophosphate (FPP) molecule into one Geranylgeranyl Pyrophosphate (GGPP) molecule. Genes encoding GGPPS may for example be found in organisms that contain the mevalonate pathway.

The GGPPS to be used with the present invention may be any useful enzyme, which is capable of catalysing conversion of a farnesyl pyrophosphate (FPP) molecule into a Geranylgeranyl Pyrophosphate (GGPP) molecule. In particular, the GGPPS to be used with the present invention may be any enzyme capable of catalysing the following reaction:

(2E,6E)-farnesyl diphosphate+isopentenyl diphosphate→diphosphate+geranylgeranyl diphosphate.

It is preferred that the GGPPS used with the present invention is an enzyme categorised under EC 2.5.1.29.

The GGPPS may be GGPPS from a variety of sources, such as from bacteria, fungi or mammals. The GGPPS may be any kind of GGPPS, for example GGPPS-1, GGPPS-2, GGPPS-3 or GGPPS-4. The GGPPS may be wild type GGPPS or a functional homologue thereof.

For example, the GGPPS may be GGPPS-1 of *S. acidicaldarius* (SEQ ID NO: 126), GGPPS-2 of *A. nidulans* (SEQ ID NO: 203), GGPPS-3 of *S. cerevisiae* (SEQ ID NO: 167) or GGPPS-4 of *M. musculus* (SEQ ID NO:123) or a functional homologue of any of the aforementioned.

The heterologous nucleic acid encoding said GGPPS may be any nucleic acid sequence encoding said GGPPS. Thus, in embodiments of the invention where GGPPS is a wild type protein, the nucleic acid sequence may for example be a wild type cDNA sequence encoding said protein. However, it is frequently the case that the heterologous nucleic acid is nucleic acid sequence encoding any particular GGPPS, where said nucleic acid has been codon optimised for the particular microbial cell. Thus, by way of example, if the microbial cell is *S. cerevisiae*, then the nucleic acid encoding GGPPS has preferably been codon optimised for optimal expression in *S. cerevisiae*.

Functional homologues of GGPPS are preferably protein having above-mentioned activity and sharing at least 70% amino acid identity with the sequence of a reference GGPPS. Methods for determining sequence identity are described herein above in the section "Squalene synthase" and in section D.

In one embodiment, the cell, such as the microbial of the present invention comprises a nucleic acid sequence coding a GGPPS or a functional homologue thereof, where said functional homologue is at least 75%, such as at least 76%, such as at least 77%, such as at least 78%, such as at least 79%, such as at least 80%, such as at least 81%, such as at least 82%, such as at least 83%, such as at least 84%, such as at least 85%, such as at least 86%, such as at least 87%, such as at least 88%, such as at least 89%, such as at least 90%, such as at least 91%, such as at least 92%, such as at least 93%, such as at least 94%, such as at least 95%, such as at least 96%, such as at least 97%, such as at least 98%, such as at least 99%, such as at least 99.5%, such as at least 99.6%, such as at least 99.7%, such as at least 99.8%, such as at least 99.9%, such as 100% identical to a GGPPS selected from the group consisting of SEQ ID NO:123, SEQ ID NO:126, SEQ ID NO:167 and SEQ ID NO:203.

Said heterologous nucleic acid sequence encoding a GGPPS is in general operably linked to a nucleic acid sequence directing expression of GGPPS in the microbial cell. The nucleic acid sequence directing expression of GGPPS in the microbial cell may be a promoter sequence, and preferably said promoter sequence is selected according the particular microbial cell. The promoter may for example be any of the promoters described herein above in the section "Promoter"

Vectors

A vector is a DNA molecule used as a vehicle to transfer foreign genetic material into another cell. The major types of vectors are plasmids, viruses, cosmids, and artificial chromosomes. Common to all engineered vectors is an origin of replication, a multicloning site, and a selectable marker.

The vector itself is generally a DNA sequence that consists of an insert (transgene) and a larger sequence that serves as the "backbone" of the vector. The purpose of a vector which transfers genetic information to another cell is typically to isolate, multiply, or express the insert in the target cell. Vectors called expression vectors (expression constructs) specifically are for the expression of the transgene in the target cell, and generally have a promoter sequence that drives expression of the transgene. Simpler vectors called transcription vectors are only capable of being transcribed but not translated: they can be replicated in a target cell but not expressed, unlike expression vectors. Transcription vectors are used to amplify their insert.

Insertion of a vector into the target cell is usually called transformation for bacterial cells, transfection for eukaryotic cells, although insertion of a viral vector is often called transduction.

Plasmids

Plasmid vectors are double-stranded generally circular DNA sequences that are capable of automatically replicating in a host cell. Plasmid vectors minimalistically consist of an origin of replication that allows for semi-independent replication of the plasmid in the host and also the transgene insert. Modern plasmids generally have many more features, notably including a "multiple cloning site" which includes nucleotide overhangs for insertion of an insert, and multiple restriction enzyme consensus sites to either side of the insert. In the case of plasmids utilized as transcription vectors, incubating bacteria with plasmids generates hundreds or thousands of copies of the vector within the bacteria in hours, and the vectors can be extracted from the bacteria, and the multiple cloning site can be cut by restriction enzymes to excise the hundredfold or thousandfold amplified insert. These plasmid transcription vectors characteristically lack crucial sequences that code for polyadenylation sequences and translation termination sequences in translated mRNAs, making protein expression from transcription vectors impossible. Plasmids may be conjugative/transmissible and non-conjugative:

- conjugative: mediate DNA transfer through conjugation and therefore spread rapidly among the bacterial cells of a population; e.g., F plasmid, many R and some col plasmids.
- nonconjugative—do not mediate DNA through conjugation, e.g., many R and col plasmids.

Viral Vectors

Viral vectors are generally genetically-engineered viruses carrying modified viral DNA or RNA that has been rendered noninfectious, but still contain viral promoters and also the transgene, thus allowing for translation of the transgene through a viral promoter. However, because viral vectors frequently are lacking infectious sequences, they require helper viruses or packaging lines for large-scale transfection. Viral vectors are often designed for permanent incorporation of the insert into the host genome, and thus leave distinct genetic markers in the host genome after incorporating the transgene. For example, retroviruses leave a characteristic retroviral integration pattern after insertion that is detectable and indicates that the viral vector has incorporated into the host genome.

In one embodiment the invention concerns a viral vector capable of transfecting a host cell, such as a cell that can be cultured, e.g. a yeast cell or any other suitable eukaryotic cell. The vector is then capable of transfecting said cell with a nucleic acid that includes the heterologous insert sequence as described herein.

The viral vector can be any suitable viral vector such as a viral vector selected from the group consisting of vectors derived from the Retroviridae family including lentivirus, HIV, SIV, FIV, EAIV, CIV.

The viral vector may also be selected from the group consisting of alphavirus, adenovirus, adeno associated virus, baculovirus, HSV, coronavirus, Bovine papilloma virus, Mo-MLV and adeno associated virus.

In embodiments of the invention wherein the microbial cell comprises a heterologous nucleic acid encoding GGPPS, then said heterologous nucleic acid may be positioned on the vector also containing the nucleic acid encoding squalene synthase, or the heterologous nucleic acid encoding GGPPS may be positioned on a different vector. Said heterologous nucleic acid encoding GGPPS may be contained in any of the vectors described herein above.

In embodiments of the invention wherein the microbial cell comprises a heterologous nucleic acid encoding HMCR, then said heterologous nucleic acid may be positioned on the vector also containing the nucleic acid encoding squalene synthase, or the heterologous nucleic acid encoding HMCR may be positioned on a different vector. Said heterologous nucleic acid encoding HMCR may be contained in any of the vectors described herein above. It is also contained within the invention that the heterologous nucleic acid encoding GGPPS and the heterologous nucleci acid encoding HMCR may be positioned on the same or on individual vectors.

Transcription

Transcription is a necessary component in all vectors: the premise of a vector is to multiply the insert (although expression vectors later also drive the translation of the multiplied insert). Thus, even stable expression is determined by stable transcription, which generally depends on promoters in the vector. However, expression vectors have a variety of expression patterns: constitutive (consistent expression) or inducible (expression only under certain conditions or chemicals). This expression is based on different promoter activities, not post-transcriptional activities. Thus, these two different types of expression vectors depend on different types of promoters.

Viral promoters are often used for constitutive expression in plasmids and in viral vectors because they normally reliably force constant transcription in many cell lines and types.

Inducible expression depends on promoters that respond to the induction conditions: for example, the murine mammary tumor virus promoter only initiates transcription after dexamethasone application and the *Drosophilia* heat shock promoter only initiates after high temperatures. Transcription is the synthesis of mRNA. Genetic information is copied from DNA to RNA Expression Expression vectors require sequences that encode for e.g. polyadenylation tail (see herein above): Creates a polyadenylation tail at the end of the transcribed pre-mRNA that protects the mRNA from exonucleases and ensures transcriptional and translational termination: stabilizes mRNA production.

Minimal UTR length: UTRs contain specific characteristics that may impede transcription or translation, and thus the shortest UTRs or none at all are encoded for in optimal expression vectors.

Kozak sequence: Vectors should encode for a Kozak sequence in the mRNA, which assembles the ribosome for translation of the mRNA.

Above conditions are necessary for expression vectors in eukaryotes but not in prokaryotes.

Modern vectors may encompass additional features besides the transgene insert and a backbone such as a promoter (discussed above), genetic markers to e.g. allow for confirmation that the vector has integrated with the host genomic DNA, antibiotic resistance genes for antibiotic selection, and affinity tags for purification.

In one embodiment the cell of the present invention comprises a nucleic acid sequence integrated in a vector such as an expression vector.

In one embodiment the vector is selected from the group consisting of plasmid vectors, cosmids, artificial chromosomes and viral vectors.

The plasmid vector should be able to be maintained and replicated in bacteria, fungi and yeast.

The present invention also concerns cells comprising plasmid and cosmid vectors as well as artificial chromosome vectors.

The important factor is that the vector is functional and that the vector comprises at least the nucleic acid sequence comprising the heterologous insert sequence as described herein.

In one embodiment the vector is functional in fungi and in mammalian cells.

In one embodiment the invention concerns a cell transformed or transduced with the vector as defined herein above.

Methods for Producing Terpenoids

As mentioned herein above, the cell of the present invention (e.g., recombinant host cells) is useful in enhancing yield of industrially relevant terpenoids.

The cell of the invention may therefore be used in various set-ups in order to increase accumulation of terpenoid precursors and thus to increase yield of terpenoid products resulting from enzymatic conversion of said (upstream) terpenoid precursors.

Accordingly, in one aspect the present invention relates to a method for producing a terpenoid compound synthesized through the squalene pathway, in a cell culture, said method comprising the steps of (a) providing the cell as defined herein above, (b) culturing the cell of (a).

(c) recovering the terpenoid product compound.

Figure 20:
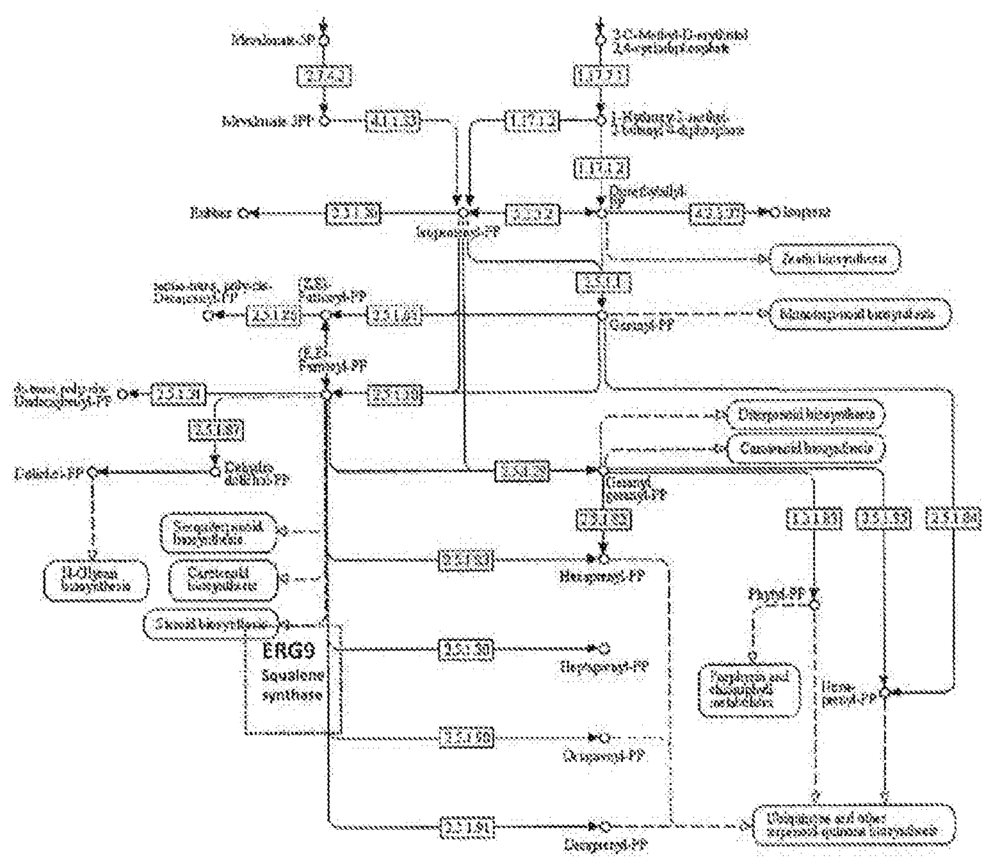
FIG. 20 is a schematic of the isoprenoid pathway in yeast, showing the position of ERG9.

By providing the cell comprising the genetically modified construct defined herein above, the accumulation of terpenoid precursors is enhanced (FIG. 20).

Thus, in another aspect, the invention relates to a method for producing a terpenoid derived from a terpenoid precursor selected from the group consisting of Farnesyl-pyrophosphate (FPP), Isopentenyl-pyrophosphate (IPP), Dimethylallyl-pyrophosphate (DMAPP), Geranyl-pyrophosphate (GPP) and/or Geranylgeranyl-pyrophosphate (GGPP), said method comprising:

(a) contacting said precursor with an enzyme of the squalene synthase pathway, (b) recovering the terpenoid product.

In one embodiment the terpenoid (product) of the method of the present invention as defined herein above, is selected from the group consisting of hemiterpenoids, monoterpenes, sesquiterpenoids, diterpenoids, sesterpenes, triterpenoids, tetraterpenoids and polyterpenoids.

In a further embodiment the terpenoid is selected from the group consisting of farnesyl phosphate, farnesol, geranylgeranyl, geranylgeraniol, isoprene, prenol, isovaleric acid, geranyl pyrophosphate, eucalyptol, limonene, pinene, farnesyl pyrophosphate, artemisinin, bisabolol, geranylgeranyl pyrophosphate, retinol, retinal, phytol, taxol, forskolin, aphidicolin, lanosterol, lycopene and carotene.

The terpenoid product can be used as starting point in an additional refining process. Thus, in one embodiment said method further comprises dephosphorylating the farnesyl phosphate to produce farnesol.

The enzyme or enzymes used in the process of preparing the target product terpenoid compound is preferably an enzyme "located downstream" of the terpenoid precursors Farnesyl-pyrophosphate, Isopentenyl-pyrophosphate, Dimethylallyl-pyrophosphate, Geranyl-pyrophosphate and Geranylgeranyl-pyrophosphate such as an enzyme located downstream of the terpenoid precursors Farnesyl-pyrophosphate, Isopentenyl-pyrophosphate, Dimethylallyl-pyrophosphate, Geranyl-pyrophosphate and Geranylgeranyl-pyrophosphate depicted in the squalene pathway of FIG. 20. The enzyme used in the process of preparing the target product terpenoid, based on the accumulation of precursors achieved through the present invention, may thus be selected from the group consisting of Dimethylallyltransferase (EC 2.5.1.1), Isoprene synthase (EC 4.2.3.27) and Geranyltranstransferase (EC 2.5.1.10).

The present invention may operate by at least partly, sterically hindering binding of the ribosome to the RNA thus reducing the translation of squalene synthase. Accordingly, in one aspect the present invention relates to a method for reducing the translation rate of a functional squalene synthase (EC 2.5.1.21) said method comprising:

(a) providing the cell defined herein above, (b) culturing the cell of (a).

Similarly, the invention in another aspect relates to a method for decreasing turnover of farnesyl-pp to squalene, said method comprising:

(a) providing the cell defined herein above, (b) culturing the cell of (a).

As depicted in FIG. 20, the knocking down of the ERG9 results in build-up of precursors to squalene synthase. Thus in one aspect, the present invention relates to a method for enhancing accumulation of a compound selected from the group consisting of Farnesyl-pyrophosphate, Isopentenyl-pyrophosphate, Dimethylallyl-pyrophosphate, Geranyl-pyrophosphate and Geranylgeranyl-pyrophosphate, said method comprising the steps of:

(a) providing the cell defined herein above, and (b) culturing the cell of (a).

In one embodiment the method of the invention as define herein above further comprises recovering the Farnesyl-pyrophosphate, Isopentenyl-pyrophosphate, Dimethylallyl-pyrophosphate, Geranyl-pyrophosphate or Geranylgeranyl-pyrophosphate compound. The recovered compound may be used in further processes for producing the desired terpenoid product compound. The further process may take place in the same cell culture as the process performed and defined herein above, such as the accumulation of the terpenoid precursors by the cell of the present invention. Alternatively, the recovered precursors may be added to another cell culture, or a cell free system, to produce the desired products.

As the precursors are intermediates, however mainly stable intermediates, a certain endogenous production of terpenoid products may occur based on the terpenoid precursor substrates. Also, the cells of the invention may have additional genetic modifications such that they are capable of performing both the accumulation of the terpenoid precursors (construct of the cell of the invention) and whole or substantially the whole subsequent biosynthesis process to the desired terpenoid product.

Thus, in one embodiment the method of the invention further comprises recovering a compound synthesized through the squalene pathway, said compound being derived from said Farnesyl-pyrophosphate, Isopentenyl-pyrophosphate, Dimethylallyl-pyrophosphate, Geranyl-pyrophosphate and/or Geranylgeranyl-pyrophosphate. Occasionally it may be advantageous to include a squalene synthase inhibitor when culturing the cell of the present invention. Chemical inhibition of squalene synthase, e.g. by lapaquistat, is known in the art and is under investigation e.g. as a method of lowering cholesterol levels in the prevention of cardiovascular disease. It has also been suggested that variants in this enzyme may be part of a genetic association with hypercholesterolemia. Other squalene synthase inhibitors include Zaragozic acid and RPR 107393.

Thus, in one embodiment the culturing step of the method(s) defined herein above is performed in the presence of a squalene synthase inhibitor.

The cell of the invention may furthermore be genetically modified to further enhance production of certain key terpenoid precursors. In one embodiment the cell is additionally genetically modified to enhance activity of and/or overexpress one or more enzymes selected from the group consisting of Phosphomevalonate kinase (EC 2.7.4.2), Diphosphomevalonate decarboxylase (EC 4.1.1.33), 4-hydroxy-3-methylbut-2-en-1-yl diphosphate synthase (EC 1.17.7.1), 4-hydroxy-3-methylbut-2-enyl diphosphate reductase (EC 1.17.1.2), Isopentenyl-diphosphate Delta-isomerase 1 (EC 5.3.3.2), Short-chain Z-isoprenyl diphosphate synthase (EC 2.5.1.68), Dimethylallyltransferase (EC 2.5.1.1), Geranyltranstransferase (EC 2.5.1.10) and Geranylgeranyl pyrophosphate synthetase (EC 2.5.1.29).

As described herein above in one embodiment of the invention the microbial cell comprises both a nucleic acid encoding a sqalene synthase as described herein above as well as a heterologous nucleic acid encoding a GGPPS. Such microbial cells are particularly useful for the preparation of GGPP as well as terpenoids, wherein GGPP is an intermediate in their biosynthesis.

Accordingly, in one aspect the invention relates to a method for preparing GGPP, wherein the method comprises the steps of a. providing a microbial cell comprising a nucleic acid sequence, said nucleic acid comprising i) a promoter sequence operably linked to ii) a heterologous insert sequence operably linked to iii) an open reading frame operably linked to iv) a transcription termination signal, wherein the heterologous insert sequence and the open reading frame are as defined herein above, wherein said microbial cell furthermore comprises a heterologous nucleic acid encoding GGPPS operably linked to a nucleic acid sequence directing expression of GGPPS in said cell;

b. Cultivating the microbial cell of a.;

c. Recovering the GGPP.

In another aspect the invention relates to a method for preparing a terpenoid of which GGPP is an intermediate in the biosynthesis pathway, wherein the method comprises the steps of a. providing a microbial cell, wherein said microbial cell comprises a nucleic acid sequence, said nucleic acid comprising i) a promoter sequence operably linked to ii) a heterologous insert sequence operably linked to iii) an open reading frame operably linked to iv) a transcription termination signal, wherein the heterologous insert sequence and the open reading frame are as defined herein above, wherein said microbial cell furthermore comprises a heterologous nucleic acid encoding GGPPS operably linked to a nucleic acid sequence directing expression of GGPPS in said cell;

b. Cultivating the microbial cell of a; and c. Recovering the terpenoid, wherein said terpenoid may be any terpenoid described herein above in the section "Terpenoids" having GGPP as intermediate in its biosynthesises; and said microbial cell may be any of the microbial cells described herein above in the section "The cell"; and said promoter may be any promoter, such as any of the promoters described herein above in the section "Promoter"; and said heterologous insert sequence may be any of the heterologous insert sequences described herein above in the section "Heterologous insert sequence"; and said open reading frame encodes a squalene synthase, which may be any of the squalene synthases described herein above in the section "Squalene synthase"; and said GGPPS may be any of the GGPPS described herein above in the section "Geranylgeranyl Pyrophosphate Synthase".

In this embodiment said microbial cell may also optionally contain one or more additional heterologous nucleic acids encoding one or more enzymes involved in the biosynthesis pathway of said terpenoid.

In one particular aspect the invention relates to a method for preparing steviol, wherein the method comprises the steps of a. providing a microbial cell, wherein said microbial cell comprises a nucleic acid sequence, said nucleic acid comprising i) a promoter sequence operably linked to ii) a heterologous insert sequence operably linked to iii) an open reading frame operably linked to iv) a transcription termination signal, wherein the heterologous insert sequence and the open reading frame are as defined herein above, wherein said microbial cell furthermore comprises a heterologous nucleic acid encoding GGPPS operably linked to a nucleic acid sequence directing expression of GGPPS in said cell;

b. Cultivating the microbial cell of a.;

c. Recovering steviol, wherein said microbial cell may be any of the microbial cells described herein above in the section "The cell"; and said promoter may be any promoter, such as any of the promoters described herein above in the section "Promoter"; and said heterologous insert sequence may be any of the heterologous insert sequences described herein above in the section "Heterologous insert sequence"; and said open reading frame encodes a squalene synthase, which may be any of the squalene synthases described herein above in the section "Squalene synthase"; and said GGPPS may be any of the GGPPS described herein above in the section "Geranylgeranyl Pyrophosphate Synthase".

In this embodiment said microbial cell may also optionally contain one or more additional heterologous nucleic acids encoding one or more enzymes involved in the biosynthesis pathway of steviol.

In another aspect the invention relates to a method for preparing a terpenoid of which GGPP is an intermediate in the biosynthesis pathway, wherein the method comprises the steps of a. providing a microbial cell, wherein said microbial cell comprises a nucleic acid sequence, said nucleic acid comprising i) a promoter sequence operably linked to ii) a heterologous insert sequence operably linked to iii) an open reading frame operably linked to iv) a transcription termination signal, wherein the heterologous insert sequence and the open reading frame are as defined herein above, wherein said microbial cell furthermore comprises a heterologous nucleic acid encoding GGPPS operably linked to a nucleic acid sequence directing expression of GGPPS in said cell and wherein said microbial cell furthermore comprises a heterologous nucleic acid encoding HMCR operably linked to a nucleic acid sequence directing expression of HMCR in said cell;

b. Cultivating the microbial cell of a.;

c. Recovering the terpenoid, wherein said terpenoid may be any terpenoid described herein above in the section "Terpenoids" having GGPP as intermediate in its biosynthesises; and said microbial cell may be any of the microbial cells described herein above in the section "The cell"; and said promoter may be any promoter, such as any of the promoters described herein above in the section "Promoter"; and said heterologous insert sequence may be any of the heterologous insert sequences described herein above in the section "Heterologous insert sequence"; and said open reading frame encodes a squalene synthase, which may be any of the squalene synthases described herein above in the section "Squalene synthase"; and said GGPPS may be any of the GGPPS described herein above in the section "Geranylgeranyl Pyrophosphate Synthase"; and said HMCR may be any of the HMCR described herein above in the section "HMCR".

In this embodiment said microbial cell may also optionally contain one or more additional heterologous nucleic acids encoding one or more enzymes involved in the biosynthesis pathway of said terpenoid.

In one particular aspect the invention relates to a method for preparing steviol, wherein the method comprises the steps of a. providing a microbial cell, wherein said microbial cell comprises a nucleic acid sequence, said nucleic acid comprising i) a promoter sequence operably linked to ii) a heterologous insert sequence operably linked to iii) an open reading frame operably linked to iv) a transcription termination signal, wherein the heterologous insert sequence and the open reading frame are as defined herein above, wherein said microbial cell furthermore comprises a heterologous nucleic acid encoding GGPPS operably linked to a nucleic acid sequence directing expression of GGPPS in said cell;

b. Cultivating the microbial cell of a.;

c. Recovering steviol, wherein said microbial cell may be any of the microbial cells described herein above in the section "The cell"; and said promoter may be any promoter, such as any of the promoters described herein above in the section "Promoter"; and said heterologous insert sequence may be any of the heterologous insert sequences described herein above in the section "Heterologous insert sequence"; and said open reading frame encodes a squalene synthase, which may be any of the squalene synthases described herein above in the section "Squalene synthase"; and said GGPPS may be any of the GGPPS described herein above in the section "Geranylgeranyl Pyrophosphate Synthase" and said HMCR may be any of the HMCR described herein above in the section "HMCR".

In this embodiment said microbial cell may also optionally contain one or more additional heterologous nucleic acids encoding one or more enzymes involved in the biosynthesis pathway of steviol.

In one embodiment the cell is additionally genetically modified to enhance activity of and/or overexpress one or more enzymes selected from the group consisting of acetoacetyl CoA thiolose, HMG-CoA reductase or the catalytic domain thereof, HMG-CoA synthase, mevalonate kinase, phosphomevalonate kinase, phosphomevalonate decarboxylase, isopentenyl pyrophosphate isomerase, farnesyl pyrophosphate synthase, D-1-deoxyxylulose 5-phosphate synthase, and 1-deoxy-D-xylulose 5-phosphate reductoisomerase and farnesyl pyrophosphate synthase.

In one embodiment of the method of the present invention, the cell comprises a mutation in the ERG9 open reading frame.

In another embodiment of the method of the present invention the cell comprises an ERG9[Delta]::HIS3 deletion/insertion allele.

In yet another embodiment the step of recovering the compound in the method of the present invention further comprises purification of said compound from the cell culture media.

D. Functional Homologs

Functional homologs of the polypeptides described above are also suitable for use in producing steviol or steviol glycosides in a recombinant host. A functional homolog is a polypeptide that has sequence similarity to a reference polypeptide, and that carries out one or more of the biochemical or physiological function(s) of the reference polypeptide. A functional homolog and the reference polypeptide may be natural occurring polypeptides, and the sequence similarity may be due to convergent or divergent evolutionary events. As such, functional homologs are sometimes designated in the literature as homologs, or orthologs, or paralogs. Variants of a naturally occurring functional homolog, such as polypeptides encoded by mutants of a wild type coding sequence, may themselves be functional homologs. Functional homologs can also be created via site-directed mutagenesis of the coding sequence for a polypeptide, or by combining domains from the coding sequences for different naturally-occurring polypeptides ("domain swapping"). Techniques for modifying genes encoding functional UGT polypeptides described herein are known and include, inter alia, directed evolution techniques, site-directed mutagenesis techniques and random mutagenesis techniques, and can be useful to increase specific activity of a polypeptide, alter substrate specificity, alter expression levels, alter subcellular location, or modify polypeptide:polypeptide interactions in a desired manner. Such modified polypeptides are considered functional homologs. The term "functional homolog" is sometimes applied to the nucleic acid that encodes a functionally homologous polypeptide.

Functional homologs can be identified by analysis of nucleotide and polypeptide sequence alignments. For example, performing a query on a database of nucleotide or polypeptide sequences can identify homologs of steviol or steviol glycoside biosynthesis polypeptides. Sequence analysis can involve BLAST, Reciprocal BLAST, or PSI-BLAST analysis of nonredundant databases using a GGPPS, a CDPS, a KS, a KO or a KAH amino acid sequence as the reference sequence. Amino acid sequence is, in some instances, deduced from the nucleotide sequence. Those polypeptides in the database that have greater than 40% sequence identity are candidates for further evaluation for suitability as a steviol or steviol glycoside biosynthesis polypeptide. Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains present in steviol biosynthesis polypeptides, e.g., conserved functional domains.

Conserved regions can be identified by locating a region within the primary amino acid sequence of a steviol or a steviol glycoside biosynthesis polypeptide that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains on the World Wide Web at sanger.ac.uk/Software/Pfam/ and pfam.janelia.org/. The information included at the Pfam database is described in Sonnhammer et al., *Nucl. Acids Res.,* 26:320-322 (1998); Sonnhammer et al., *Proteins,* 28:405-420 (1997); and Bateman et al., *Nucl. Acids Res.,* 27:260-262 (1999). Conserved regions also can be determined by aligning sequences of the same or related polypeptides from closely related species. Closely related species preferably are from the same family. In some embodiments, alignment of sequences from two different species is adequate.

Typically, polypeptides that exhibit at least about 40% amino acid sequence identity are useful to identify conserved regions. Conserved regions of related polypeptides exhibit at least 45% amino acid sequence identity (e.g., at least 50%, at least 60%, at least 70%, at least 80%, or at least 90% amino acid sequence identity). In some embodiments, a conserved region exhibits at least 92%, 94%, 96%, 98%, or 99% amino acid sequence identity.

For example, polypeptides suitable for producing steviol glycosides in a recombinant host include functional homologs of EUGT11, UGT91D2e, UGT91D2m, UGT85C, and UGT76G. Such homologs have greater than 90% (e.g., at least 95% or 99%) sequence identity to the amino acid sequence of EUGT11 (SEQ ID NO: 152), UGT91D2e (SEQ ID NO:5), UGT91D2m (SEQ ID NO:10), UGT85C (SEQ ID NO:3), or UGT76G (SEQ ID NO:7). Variants of EUGT11, UGT91D2, UGT85C, and UGT76G polypeptides typically have 10 or fewer amino acid substitutions within the primary amino acid sequence, e.g., 7 or fewer amino acid substitutions, 5 or conservative amino acid substitutions, or between 1 and 5 substitutions. However, in some embodiments, variants of EUGT11, UGT91D2, UGT85C, and UGT76G polypeptides can have 10 or more amino acid substitutions (e.g., 10, 15, 20, 25, 30, 35, 10-20, 10-35, 20-30, or 25-35 amino acid substitutions). The substitutions may be conservative, or in some embodiments, non-conservative. Non-limiting examples of non-conservative changes in UGT91D2e polypeptides include glycine to arginine and tryptophan to arginine. Non-limiting examples of non-conservative substitutions in UGT76G polypeptides include valine to glutamic acid, glycine to glutamic acid, glutamine to alanine, and serine to proline. Non-limiting examples of changes to UGT85C polypeptides include histidine to aspartic acid, proline to serine, lysine to threonine, and threonine to arginine.

In some embodiments, a useful UGT91D2 homolog can have amino acid substitutions (e.g., conservative amino acid substitutions) in regions of the polypeptide that are outside of predicted loops, e.g., residues 20-26, 39-43, 88-95, 121-124, 142-158, 185-198, and 203-214 are predicted loops in the N-terminal domain and residues 381-386 are predicted loops in the C-terminal domain of SEQ ID NO:5. For example, a useful UGT91D2 homolog can include at least one amino acid substitution at residues 1-19, 27-38, 44-87, 96-120, 125-141, 159-184, 199-202, 215-380, or 387-473 of SEQ ID NO:5. In some embodiments, a UGT91D2 homolog can have an amino acid substitution at one or more residues selected from the group consisting of residues 30, 93, 99, 122, 140, 142, 148, 153, 156, 195, 196, 199, 206, 207, 211, 221, 286, 343, 427, and 438 of SEQ ID NO:5. For example, a UGT91D2 functional homolog can have an amino acid substitution at one or more of residues 206, 207, and 343, such as an arginine at residue 206, a cysteine at residue 207, and an arginine at residue 343 of SEQ ID NO:5. See, SEQ ID NO:95. Other functional homologs of UGT91D2 can have one or more of the following: a tyrosine or phenylalanine at residue 30, a proline or glutamine at residue 93, a serine or valine at residue 99, a tyrosine or a phenylalanine at residue 122, a histidine or tyrosine at residue 140, a serine or cysteine at residue 142, an alanine or threonine at residue 148, a methionine at residue 152, an alanine at residue 153, an alanine or serine at residue 156, a glycine at residue 162, a leucine or methionine at residue 195, a glutamic acid at residue 196, a lysine or glutamic acid at residue 199, a leucine or methionine at residue 211, a leucine at residue 213, a serine or phenylalanine at residue 221, a valine or isoleucine at residue 253, a valine or alanine at residue 286, a lysine or asparagine at residue 427, an alanine at residue 438, and either an alanine or threonine at residue 462 of SEQ ID NO:5. In another embodiment, a UGT91D2 functional homolog contains a methionine at residue 211 and an alanine at residue 286.

In some embodiments, a useful UGT85C homolog can have one or more amino acid substitutions at residues 9, 10, 13, 15, 21, 27, 60, 65, 71, 87, 91, 220, 243, 270, 289, 298, 334, 336, 350, 368, 389, 394, 397, 418, 420, 440, 441, 444, and 471 of SEQ ID NO:3. Non-limiting examples of useful UGT85C homologs include polypeptides having substitutions (with respect to SEQ ID NO:3) at residue 65 (e.g., a serine at residue 65), at residue 65 in combination with residue 15 (a leucine at residue 15), 270 (e.g., a methionine, arginine, or alanine at residue 270), 418 (e.g., a valine at residue 418), 440 (e.g., an aspartic acid at residue at residue 440), or 441 (e.g., an asparagine at residue 441); residues 13 (e.g., a phenylalanine at residue 13), 15, 60 (e.g., an aspartic acid at residue 60), 270, 289 (e.g., a histidine at residue 289), and 418; substitutions at residues 13, 60, and 270; substitutions at residues 60 and 87 (e.g., a phenylalanine at residue 87); substitutions at residues 65, 71 (e.g., a glutamine at residue 71), 220 (e.g., a threonine at residue 220), 243 (e.g., a tryptophan at residue 243), and 270; substitutions at residues 65, 71, 220, 243, 270, and 441; substitutions at residues 65, 71, 220, 389 (e.g., a valine at residue 389), and 394 (e.g., a valine at residue 394); substitutions at residues 65, 71, 270, and 289; substitutions at residues 220, 243, 270, and 334 (e.g., a serine at residue 334); or substitutions at residues 270 and 289. The following amino acid mutations did not result in a loss of activity in 85C2 polypeptides: V13F, F15L, H60D, A65S, E71Q, 187F, K220T, R243W, T270M, T270R, Q289H, L334S, A389V, 1394V, P397S, E418V, G440D, and H441N. Additional mutations that were seen in active clones include K9E, K10R, Q21H, M27V, L91P, Y298C, K350T, H368R, G420R, L431P, R444G, and M471T. In some embodiments, an UGT85C2 contains substitutions at positions 65 (e.g., a serine), 71 (a glutamine), 270 (a methionine), 289 (a histidine), and 389 (a valine).

The amino acid sequence of *Stevia rebaudiana* UGTs 74G1, 76G1 and 91D2e with N-terminal, in-frame fusions of the first 158 amino acids of human MDM2 protein, and *Stevia rebaudiana* UGT85C2 with an N-terminal in-frame fusion of 4 repeats of the synthetic PMI peptide (4×TSFAEYWNLLSP, SEQ ID NO:86) are set forth in SEQ ID NOs: 90, 88, 94, and 92, respectively; see SEQ ID NOs: 89, 92, 93, and 95 for the nucleotide sequences encoding the fusion proteins.

In some embodiments, a useful UGT76G homolog can have one or more amino acid substitutions at residues 29, 74, 87, 91, 116, 123, 125, 126, 130, 145, 192, 193, 194, 196, 198, 199, 200, 203, 204, 205, 206, 207, 208, 266, 273, 274, 284, 285, 291, 330, 331, and 346 of SEQ ID NO:7. Non-limiting examples of useful UGT76G homologs include polypeptides having substitutions (with respect to SEQ ID NO:7) at residues 74, 87, 91, 116, 123, 125, 126, 130, 145, 192, 193, 194, 196, 198, 199, 200, 203, 204, 205, 206, 207, 208, and 291; residues 74, 87, 91, 116, 123, 125, 126, 130, 145, 192, 193, 194, 196, 198, 199, 200, 203, 204, 205, 206, 207, 208, 266, 273, 274, 284, 285, and 291; or residues 74, 87, 91, 116, 123, 125, 126, 130, 145, 192, 193, 194, 196, 198, 199, 200, 203, 204, 205, 206, 207, 208, 266, 273, 274, 284, 285, 291, 330, 331, and 346. See, Table 9.

TABLE 9

| Clone | Mutations |
|---|---|
| 76G_G7 | M29I, V74E, V87G, L91P, G116E, A123T, Q125A, I126L, T130A, V145M, C192S, S193A, F194Y, M196N, K198Q, K199I, Y200L, Y203I, F204L, E205G, N206K, I207M, T208I, P266Q, S273P, R274S, G284T, T285S, 287-3 bp deletion, L330V, G331A, L346I |
| 76G_H12 | M29I, V74E, V87G, L91P, G116E, A123T, Q125A, I126L, T130A, V145M, C192S, S193A, F194Y, M196N, K198Q, K199I, Y200L, Y203I, F204L, E205G, N206K, I207M, T208I, P266Q, S273P, R274S, G284T, T285S, 287-3 bp deletion |
| 76G_C4 | M29I, V74E, V87G, L91P, G116E, A123T, Q125A, I126L, T130A, V145M, C192S, S193A, F194Y, M196N, K198Q, K199I, Y200L, Y203I, F204L, E205G, N206K, I207M, T208I |

Methods to modify the substrate specificity of, for example, EUGT11 or UGT91D2e, are known to those skilled in the art, and include without limitation site-directed/rational mutagenesis approaches, random directed evolution approaches and combinations in which random mutagenesis/saturation techniques are performed near the active site of the enzyme. For example see Sarah A. Osmani, et al. *Phytochemistry* 70 (2009) 325-347.

A candidate sequence typically has a length that is from 80 percent to 200 percent of the length of the reference sequence, e.g., 82, 85, 87, 89, 90, 93, 95, 97, 99, 100, 105, 110, 115, 120, 130, 140, 150, 160, 170, 180, 190, or 200 percent of the length of the reference sequence. A functional homolog polypeptide typically has a length that is from 95 percent to 105 percent of the length of the reference sequence, e.g., 90, 93, 95, 97, 99, 100, 105, 110, 115, or 120 percent of the length of the reference sequence, or any range between. A percent identity for any candidate nucleic acid or polypeptide relative to a reference nucleic acid or polypeptide can be determined as follows. A reference sequence (e.g., a nucleic acid sequence or an amino acid sequence) is aligned to one or more candidate sequences using the computer program ClustalW (version 1.83, default parameters), which allows alignments of nucleic acid or polypeptide sequences to be carried out across their entire length (global alignment). Chema et al., *Nucleic Acids Res.,* 31(13): 3497-500 (2003).

ClustalW calculates the best match between a reference and one or more candidate sequences, and aligns them so that identities, similarities and differences can be determined. Gaps of one or more residues can be inserted into a reference sequence, a candidate sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The ClustalW output is a sequence alignment that reflects the relationship between sequences. ClustalW can be run, for example, at the Baylor College of Medicine Search Launcher site on the World Wide Web (searchlauncher.bcm.tmc.edu/multi-align/multi-align.html) and at the European Bioinformatics Institute site on the World Wide Web (ebi.ac.uk/clustalw).

To determine percent identity of a candidate nucleic acid or amino acid sequence to a reference sequence, the sequences are aligned using ClustalW, the number of identical matches in the alignment is divided by the length of the reference sequence, and the result is multiplied by 100. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

It will be appreciated that functional UGTs can include additional amino acids that are not involved in glucosylation or other enzymatic activities carried out by the enzyme, and thus such a polypeptide can be longer than would otherwise be the case. For example, a EUGT11 polypeptide can include a purification tag (e.g., HIS tag or GST tag), a chloroplast transit peptide, a mitochondrial transit peptide, an amyloplast peptide, signal peptide, or a secretion tag added to the amino or carboxy terminus. In some embodiments, a EUGT11 polypeptide includes an amino acid sequence that functions as a reporter, e.g., a green fluorescent protein or yellow fluorescent protein.

II. Steviol and Steviol Glycoside Biosynthesis Nucleic Acids

A recombinant gene encoding a polypeptide described herein comprises the coding sequence for that polypeptide, operably linked in sense orientation to one or more regulatory regions suitable for expressing the polypeptide. Because many microorganisms are capable of expressing multiple gene products from a polycistronic mRNA, multiple polypeptides can be expressed under the control of a single regulatory region for those microorganisms, if desired. A coding sequence and a regulatory region are considered to be operably linked when the regulatory region and coding sequence are positioned so that the regulatory region is effective for regulating transcription or translation of the sequence. Typically, the translation initiation site of the translational reading frame of the coding sequence is positioned between one and about fifty nucleotides downstream of the regulatory region for a monocistronic gene.

In many cases, the coding sequence for a polypeptide described herein is identified in a species other than the recombinant host, i.e., is a heterologous nucleic acid. Thus, if the recombinant host is a microorganism, the coding sequence can be from other prokaryotic or eukaryotic microorganisms, from plants or from animals. In some case, however, the coding sequence is a sequence that is native to the host and is being reintroduced into that organism. A native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found.

"Regulatory region" refers to a nucleic acid having nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTR5), transcriptional start sites, termination sequences, polyadenylation sequences, introns, and combinations thereof. A regulatory region typically comprises at least a core (basal) promoter. A regulatory region also may include at least one control element, such as an enhancer sequence, an upstream element or an upstream activation region (UAR). A regulatory region is operably linked to a coding sequence by positioning the regulatory region and the coding sequence so that the regulatory region is effective for regulating transcription or translation of the sequence. For example, to operably link a coding sequence and a promoter sequence, the translation initiation site of the translational reading frame of the coding sequence is typically positioned between one and about fifty nucleotides downstream of the promoter. A regulatory region can, however, be positioned as much as about 5,000 nucleotides upstream of the translation initiation site, or about 2,000 nucleotides upstream of the transcription start site.

The choice of regulatory regions to be included depends upon several factors, including, but not limited to, efficiency, selectability, inducibility, desired expression level, and preferential expression during certain culture stages. It is a routine matter for one of skill in the art to modulate the expression of a coding sequence by appropriately selecting and positioning regulatory regions relative to the coding sequence. It will be understood that more than one regulatory region may be present, e.g., introns, enhancers, upstream activation regions, transcription terminators, and inducible elements.

One or more genes can be combined in a recombinant nucleic acid construct in "modules" useful for a discrete aspect of steviol and/or steviol glycoside production. Combining a plurality of genes in a module, particularly a polycistronic module, facilitates the use of the module in a variety of species. For example, a steviol biosynthesis gene cluster, or a UGT gene cluster, can be combined in a polycistronic module such that, after insertion of a suitable regulatory region, the module can be introduced into a wide variety of species. As another example, a UGT gene cluster can be combined such that each UGT coding sequence is operably linked to a separate regulatory region, to form a UGT module. Such a module can be used in those species for which monocistronic expression is necessary or desirable. In addition to genes useful for steviol or steviol glycoside production, a recombinant construct typically also contains an origin of replication, and one or more selectable markers for maintenance of the construct in appropriate species.

It will be appreciated that because of the degeneracy of the genetic code, a number of nucleic acids can encode a particular polypeptide; i.e., for many amino acids, there is more than one nucleotide triplet that serves as the codon for the amino acid. Thus, codons in the coding sequence for a given polypeptide can be modified such that optimal expression in a particular host is obtained, using appropriate codon bias tables for that host (e.g., microorganism). SEQ ID NOs: 18-25, 34-36, 40-43, 48-49, 52-55, 60-64, 70-72, and 154 set forth nucleotide sequences encoding certain enzymes for steviol and steviol glycoside biosynthesis, modified for increased expression in yeast. As isolated nucleic acids, these modified sequences can exist as purified molecules and can be incorporated into a vector or a virus for use in constructing modules for recombinant nucleic acid constructs.

In some cases, it is desirable to inhibit one or more functions of an endogenous polypeptide in order to divert metabolic intermediates towards steviol or steviol glycoside biosynthesis. For example, it may be desirable to downregulate synthesis of sterols in a yeast strain in order to further increase steviol or steviol glycoside production, e.g., by downregulating squalene epoxidase. As another example, it may be desirable to inhibit degradative functions of certain endogenous gene products, e.g., glycohydrolases that remove glucose moieties from secondary metabolites or phosphatases as discussed herein. As another example, expression of membrane transporters involved in transport of steviol glycosides can be inhibited, such that secretion of glycosylated steviosides is inhibited. Such regulation can be beneficial in that secretion of steviol glycosides can be inhibited for a desired period of time during culture of the microorganism, thereby increasing the yield of glycoside product(s) at harvest. In such cases, a nucleic acid that inhibits expression of the polypeptide or gene product may be included in a recombinant construct that is transformed into the strain. Alternatively, mutagenesis can be used to generate mutants in genes for which it is desired to inhibit function.

III. Hosts

A. Microorganisms

A number of prokaryotes and eukaryotes are suitable for use in constructing the recombinant microorganisms described herein, e.g., gram-negative bacteria, yeast and fungi. A species and strain selected for use as a steviol or steviol glycoside production strain is first analyzed to determine which production genes are endogenous to the strain and which genes are not present. Genes for which an endogenous counterpart is not present in the strain are assembled in one or more recombinant constructs, which are then transformed into the strain in order to supply the missing function(s).

Exemplary prokaryotic and eukaryotic species are described in more detail below. However, it will be appreciated that other species may be suitable. For example, suitable species may be in a genus selected from the group consisting of *Agaricus, Aspergillus, Bacillus, Candida, Corynebacterium, Escherichia, Fusarium/Gibberella, Kluyveromyces, Laetiporus, Lentinus, Phaffia, Phanerochaete, Pichia, Physcomitrella, Rhodoturula, Saccharomyces, Schizosaccharomyces, Sphaceloma, Xanthophyllomyces* and *Yarrowia*. Exemplary species from such genera include *Lentinus tigrinus, Laetiporus sulphureus, Phanerochaete chrysosporium, Pichia pastoris, Physcomitrella patens, Rhodoturula glutinis* 32, *Rhodoturula mucilaginosa, Phaffia rhodozyma* UBV-AX, *Xanthophyllomyces dendrorhous, Fusarium fujikuroi/Gibberella fujikuroi, Candida utilis* and *Yarrowia lipolytica*. In some embodiments, a microorganism can be an Ascomycete such as *Gibberella fujikuroi, Kluyveromyces lactis, Schizosaccharomyces pombe, Aspergillus niger*, or *Saccharomyces cerevisiae*. In some embodiments, a microorganism can be a prokaryote such as *Escherichia coli, Rhodobacter sphaeroides*, or *Rhodobacter capsulatus*. It will be appreciated that certain microorganisms can be used to screen and test genes of interest in a high throughput manner, while other microorganisms with desired productivity or growth characteristics can be used for large-scale production of steviol glycosides.

*Saccharomyces cerevisiae*

*Saccharomyces cerevisiae* is a widely used chassis organism in synthetic biology, and can be used as the recombinant microorganism platform. There are libraries of mutants, plasmids, detailed computer models of metabolism and other information available for *S. cerevisiae*, allowing for rational design of various modules to enhance product yield. Methods are known for making recombinant microorganisms.

A steviol biosynthesis gene cluster can be expressed in yeast using any of a number of known promoters. Strains that overproduce terpenes are known and can be used to increase the amount of geranylgeranyl diphosphate available for steviol and steviol glycoside production.

*Aspergillus* spp.

*Aspergillus* species such as *A. oryzae, A. niger* and *A. sojae* are widely used microorganisms in food production, and can also be used as the recombinant microorganism platform. Nucleotide sequences are available for genomes of *A. nidulans, A. fumigatus, A. oryzae, A. clavatus, A. flavus, A. niger*, and *A. terreus*, allowing rational design and modification of endogenous pathways to enhance flux and increase product yield. Metabolic models have been developed for *Aspergillus*, as well as transcriptomic studies and proteomics studies. *A. niger* is cultured for the industrial production of a number of food ingredients such as citric acid and gluconic acid, and thus species such as *A. niger* are generally suitable for the production of food ingredients such as steviol and steviol glycosides.

*Escherichia coli*

*Escherichia coli*, another widely used platform organism in synthetic biology, can also be used as the recombinant microorganism platform. Similar to *Saccharomyces*, there are libraries of mutants, plasmids, detailed computer models of metabolism and other information available for *E. coli*, allowing for rational design of various modules to enhance product yield. Methods similar to those described above for *Saccharomyces* can be used to make recombinant *E. coli* microorganisms.

*Agaricus, Gibberella*, and *Phanerochaete* spp.

*Agaricus, Gibberella*, and *Phanerochaete* spp. can be useful because they are known to produce large amounts of gibberellin in culture. Thus, the terpene precursors for producing large amounts of steviol and steviol glycosides are already produced by endogenous genes. Thus, modules containing recombinant genes for steviol or steviol glycoside biosynthesis polypeptides can be introduced into species from such genera without the necessity of introducing mevalonate or MEP pathway genes.

*Arxula adeninivorans* (*Blastobotrys adeninivorans*)

*Arxula adeninivorans* is a dimorphic yeast (it grows as a budding yeast like the baker's yeast up to a temperature of 42° C., above this threshold it grows in a filamentous form) with unusual biochemical characteristics. It can grow on a wide range of substrates and can assimilate nitrate. It has successfully been applied to the generation of strains that can produce natural plastics or the development of a biosensor for estrogens in environmental samples.

*Yarrowia lipolytica*

*Yarrowia lipolytica* is a dimorphic yeast (see *Arxula adeninivorans*) that can grow on a wide range of substrates. It has a high potential for industrial applications but there are no recombinant products commercially available yet.

*Rhodobacter* spp.

*Rhodobacter* can be use as the recombinant microorganism platform. Similar to *E. coli*, there are libraries of mutants available as well as suitable plasmid vectors, allowing for rational design of various modules to enhance product yield. Isoprenoid pathways have been engineered in membraneous bacterial species of *Rhodobacter* for increased production of carotenoid and CoQ10. See, U.S. Patent Publication Nos. 20050003474 and 20040078846. Methods similar to those described above for *E. coli* can be used to make recombinant *Rhodobacter* microorganisms.

*Candida boidinii*

*Candida boidinii* is a methylotrophic yeast (it can grow on methanol). Like other methylotrophic species such as *Hansenula polymorpha* and *Pichia pastoris*, it provides an excellent platform for the production of heterologous proteins. Yields in a multigram range of a secreted foreign protein have been reported. A computational method, IPRO, recently predicted mutations that experimentally switched the cofactor specificity of *Candida boidinii* xylose reductase from NADPH to NADH.

*Hansenula polymorpha* (*Pichia angusta*)

*Hansenula polymorpha* is another methylotrophic yeast (see *Candida boidinii*). It can furthermore grow on a wide range of other substrates; it is thermo-tolerant and can assimilate nitrate (see also *Kluyveromyces lactis*). It has been applied to the production of hepatitis B vaccines, insulin and interferon alpha-2a for the treatment of hepatitis C, furthermore to a range of technical enzymes.

*Kluyveromyces lactis*

*Kluyveromyces lactis* is a yeast regularly applied to the production of kefir. It can grow on several sugars, most importantly on lactose which is present in milk and whey. It has successfully been applied among others to the production of chymosin (an enzyme that is usually present in the stomach of calves) for the production of cheese. Production takes place in fermenters on a 40,000 L scale.

*Pichia pastoris*

*Pichia pastoris* is a methylotrophic yeast (see *Candida boidinii* and *Hansenula* polymorphs). It provides an efficient platform for the production of foreign proteins. Platform elements are available as a kit and it is worldwide used in academia for the production of proteins. Strains have been engineered that can produce complex human N-glycan (yeast glycans are similar but not identical to those found in humans).

*Physcomitrella* spp.

*Physcomitrella* mosses, when grown in suspension culture, have characteristics similar to yeast or other fungal cultures. This genera is becoming an important type of cell for production of plant secondary metabolites, which can be difficult to produce in other types of cells.

B. Plant Cells or Plants

In some embodiments, the nucleic acids and polypeptides described herein are introduced into plants or plant cells to increase overall steviol glycoside production or enrich for the production of specific steviol glycosides in proportion to others. Thus, a host can be a plant or a plant cell that includes at least one recombinant gene described herein. A plant or plant cell can be transformed by having a recombinant gene integrated into its genome, i.e., can be stably transformed. Stably transformed cells typically retain the introduced nucleic acid with each cell division. A plant or plant cell can also be transiently transformed such that the recombinant gene is not integrated into its genome. Transiently transformed cells typically lose all or some portion of the introduced nucleic acid with each cell division such that the introduced nucleic acid cannot be detected in daughter cells after a sufficient number of cell divisions. Both transiently transformed and stably transformed transgenic plants and plant cells can be useful in the methods described herein.

Transgenic plant cells used in methods described herein can constitute part or all of a whole plant. Such plants can be grown in a manner suitable for the species under consideration, either in a growth chamber, a greenhouse, or in a field. Transgenic plants can be bred as desired for a particular purpose, e.g., to introduce a recombinant nucleic acid into other lines, to transfer a recombinant nucleic acid to other species, or for further selection of other desirable traits. Alternatively, transgenic plants can be propagated vegetatively for those species amenable to such techniques. As used herein, a transgenic plant also refers to progeny of an initial transgenic plant provided the progeny inherits the transgene. Seeds produced by a transgenic plant can be grown and then selfed (or outcrossed and selfed) to obtain seeds homozygous for the nucleic acid construct.

Transgenic plants can be grown in suspension culture, or tissue or organ culture. For the purposes of this invention, solid and/or liquid tissue culture techniques can be used. When using solid medium, transgenic plant cells can be placed directly onto the medium or can be placed onto a filter that is then placed in contact with the medium. When using liquid medium, transgenic plant cells can be placed onto a flotation device, e.g., a porous membrane that contacts the liquid medium.

When transiently transformed plant cells are used, a reporter sequence encoding a reporter polypeptide having a reporter activity can be included in the transformation procedure and an assay for reporter activity or expression can be performed at a suitable time after transformation. A suitable time for conducting the assay typically is about 1-21 days after transformation, e.g., about 1-14 days, about 1-7 days, or about 1-3 days. The use of transient assays is particularly convenient for rapid analysis in different species, or to confirm expression of a heterologous polypeptide whose expression has not previously been confirmed in particular recipient cells.

Techniques for introducing nucleic acids into monocotyledonous and dicotyledonous plants are known in the art, and include, without limitation, *Agrobacterium*-mediated transformation, viral vector-mediated transformation, electroporation and particle gun transformation, U.S. Pat. Nos. 5,538,880; 5,204,253; 6,329,571; and 6,013,863. If a cell or cultured tissue is used as the recipient tissue for transformation, plants can be regenerated from transformed cultures if desired, by techniques known to those skilled in the art.

A population of transgenic plants can be screened and/or selected for those members of the population that have a trait or phenotype conferred by expression of the transgene. For example, a population of progeny of a single transformation event can be screened for those plants having a desired level of expression of a steviol or steviol glycoside biosynthesis polypeptide or nucleic acid. Physical and biochemical methods can be used to identify expression levels. These include Southern analysis or PCR amplification for detection of a polynucleotide; Northern blots, S1 RNase protection, primer-extension, or RT-PCR amplification for detecting RNA transcripts; enzymatic assays for detecting enzyme or ribozyme activity of polypeptides and polynucleotides; and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or nucleic acids. Methods for performing all of the referenced techniques are known. As an alternative, a population of plants comprising independent transformation events can be screened for those plants having a desired trait, such as production of a steviol glycoside or modulated biosynthesis of a steviol glycoside. Selection and/or screening can be carried out over one or more generations, and/or in more than one geographic location. In some cases, transgenic plants can be grown and selected under conditions which induce a desired phenotype or are otherwise necessary to produce a desired phenotype in a transgenic plant. In addition, selection and/or screening can be applied during a particular developmental stage in which the phenotype is expected to be exhibited by the plant. Selection and/or screening can be carried out to choose those transgenic plants having a statistically significant difference in a steviol glycoside level relative to a control plant that lacks the transgene.

The nucleic acids, recombinant genes, and constructs described herein can be used to transform a number of monocotyledonous and dicotyledonous plants and plant cell systems. Non-limiting examples of suitable monocots include, for example, cereal crops such as rice, rye, *sorghum*, millet, wheat, maize, and barley. The plant may be a non-cereal monocot such as asparagus, banana, or onion. The plant also may be a dicot such as *stevia* (*Stevia rebaudiana*), soybean, cotton, sunflower, pea, geranium, spinach, or tobacco. In some cases, the plant may contain the precursor pathways for phenyl phosphate production such as the mevalonate pathway, typically found in the cytoplasm and mitochondria. The non-mevalonate pathway is more often found in plant plastids [Dubey, et al., 2003 *J. Biosci.* 28 637-646]. One with skill in the art may target expression of steviol glycoside biosynthesis polypeptides to the appropriate organelle through the use of leader sequences, such that steviol glycoside biosynthesis occurs in the desired location of the plant cell. One with skill in the art will use appropriate promoters to direct synthesis, e.g., to the leaf of a plant, if so desired. Expression may also occur in tissue cultures such as callus culture or hairy root culture, if so desired.

In one embodiment, one or more nucleic acid or polypeptides described herein are introduced into *Stevia* (e.g., *Stevia rebaudiana*) such that overall steviol glycoside biosynthesis is increased or that the overall steviol glycoside composition is selectively enriched for one or more specific steviol glycosides (e.g., rebaudioside D). For example, one or more recombinant genes can be introduced into *Stevia* such that a EUGT11 enzyme (e.g., SEQ ID NO: 152 or a functional homolog thereof) is expressed alone or in combination with one or more of: a UGT91D enzyme such as UGT91D2e (e.g., SEQ ID NO:5 or a functional homolog thereof), UGT91D2m (e.g., SEQ ID NO:10); a UGT85C enzyme such as a variant described in the "Functional Homolog" section, a UGT76G1 enzyme such as a variant described in the "Functional Homolog" section, or a UGT74G1 enzyme. Nucleic acid constructs typically include a suitable promoter (e.g., 35S, e35S, or ssRUBISCO promoters) operably linked to a nucleic acid encoding the UGT polypeptide. Nucleic acids can be introduced into *Stevia* by *Agrobacterium*-mediated transformation; electroporation-mediated gene transfer to protoplasts; or by particle bombardment. See, e.g., Singh, et al., Compendium of Transgenic Crop Plants: Transgenic Sugar, Tuber and Fiber, Edited by Chittaranjan Kole and Timothy C. Hall, Blackwell Publishing Ltd. (2008), pp. 97-115. For particle bombardment of *stevia* leaf derived callus, the parameters can be as follows: 6 cm distance, 1100 psi He pressure, gold particles, and one bombardment.

*Stevia* plants can be regenerated by somatic embryogenesis as described by Singh et al., 2008, supra. In particular, leaf segments (approximately 1-2 cm long) can be removed from 5 to 6-week-old in vitro raised plants and incubated (adaxial side down) on MS medium supplemented with B5 vitamins, 30 g sucrose and 3 g Gelrite. 2,4-dichlorophenoxyacetic acid (2,4-D) can be used in combination with 6-benzyl adenine (BA), kinetin (KN), or zeatin. Proembryogenic masses appear after 8 weeks of subculture. Within 2-3 weeks of subcultures, somatic embryos will appear on the surface of cultures. Embryos can be matured in medium containing BA in combination with 2,4-D, a-naphthaleneacetic acid (NAA), or indolbutyric acid (IBA). Mature somatic embryos that germinate and form plantlets can be excised from calli. After plantlets reach 3-4 weeks, the plantlets can be transferred to pots with vermiculite and grown for 6-8 weeks in growth chambers for acclimatization and transferred to greenhouses.

In one embodiment, steviol glycosides are produced in rice. Rice and maize are readily transformable using techniques such as *Agrobacterium*-mediated transformation. Binary vector systems are commonly utilized for *Agrobacterium* exogenous gene introduction to monocots. See, for example, U.S. Pat. Nos. 6,215,051 and 6,329,571. In a binary vector system, one vector contains the T-DNA region, which includes a gene of interest (e.g., a UGT described herein) and the other vector is a disarmed Ti plasmid containing the vir region. Co-integrated vectors and mobilizable vectors also can be used. The types and pretreatment of tissues to be transformed, the strain of *Agrobacterium* used, the duration of the inoculation, the prevention of overgrowth and necrosis by the *Agrobacterium*, can be readily adjusted by one of skill in the art. Immature embryo cells of rice can be prepared for transformation with *Agrobacterium* using binary vectors. The culture medium used is supplemented with phenolic compounds. Alternatively, the transformation can be done in planta using vacuum infiltration. See, for example, WO 2000037663, WO 2000063400, and WO 2001012828.

IV. Methods OF Producing Steviol Glycosides

Recombinant hosts described herein can be used in methods to produce steviol or steviol glycosides. For example, if the recombinant host is a microorganism, the method can include growing the recombinant microorganism in a culture medium under conditions in which steviol and/or steviol glycoside biosynthesis genes are expressed. The recombinant microorganism may be grown in a fed batch or continuous process. Typically, the recombinant microorganism is grown in a fermentor at a defined temperature(s) for a desired period of time. Depending on the particular microorganism used in the method, other recombinant genes such as isopentenyl biosynthesis genes and terpene synthase and cyclase genes may also be present and expressed. Levels of substrates and intermediates, e.g., isopentenyl diphosphate, dimethylallyl diphosphate, geranylgeranyl diphosphate, kaurene and kaurenoic acid, can be determined by extracting samples from culture media for analysis according to published methods.

After the recombinant microorganism has been grown in culture for the desired period of time, steviol and/or one or more steviol glycosides can then be recovered from the culture using various techniques known in the art. In some embodiments, a permeabilizing agent can be added to aid the feedstock entering into the host and product getting out. If the recombinant host is a plant or plant cells, steviol or steviol glycosides can be extracted from the plant tissue using various techniques known in the art. For example, a crude lysate of the cultured microorganism or plant tissue can be centrifuged to obtain a supernatant. The resulting supernatant can then be applied to a chromatography column, e.g., a C-18 column, and washed with water to remove hydrophilic compounds, followed by elution of the compound(s) of interest with a solvent such as methanol. The compound(s) can then be further purified by preparative HPLC. See also WO 2009/140394.

The amount of steviol glycoside (e.g., rebaudioside D) produced can be from about 1 mg/L to about 1500 mg/L, e.g., about 1 to about 10 mg/L, about 3 to about 10 mg/L, about 5 to about 20 mg/L, about 10 to about 50 mg/L, about 10 to about 100 mg/L, about 25 to about 500 mg/L, about 100 to about 1,500 mg/L, or about 200 to about 1,000 mg/L. In general, longer culture times will lead to greater amounts of product. Thus, the recombinant microorganism can be cultured for from 1 day to 7 days, from 1 day to 5 days, from 3 days to 5 days, about 3 days, about 4 days, or about 5 days.

It will be appreciated that the various genes and modules discussed herein can be present in two or more recombinant microorganisms rather than a single microorganism. When a plurality of recombinant microorganisms is used, they can be grown in a mixed culture to produce steviol and/or steviol glycosides. For example, a first microorganism can comprise one or more biosynthesis genes for producing steviol while a second microorganism comprises steviol glycoside biosynthesis genes. Alternatively, the two or more microorganisms each can be grown in a separate culture medium and the product of the first culture medium, e.g., steviol, can be introduced into second culture medium to be converted into a subsequent intermediate, or into an end product such as rebaudioside A. The product produced by the second, or final microorganism is then recovered. It will also be appreciated that in some embodiments, a recombinant microorganism is grown using nutrient sources other than a culture medium and utilizing a system other than a fermentor.

Steviol glycosides do not necessarily have equivalent performance in different food systems. It is therefore desirable to have the ability to direct the synthesis to steviol glycoside compositions of choice. Recombinant hosts described herein can produce compositions that are selectively enriched for specific steviol glycosides (e.g., rebaudioside D) and have a consistent taste profile. Thus, the recombinant microorganisms, plants, and plant cells described herein can facilitate the production of compositions that are tailored to meet the sweetening profile desired for a given food product and that have a proportion of each steviol glycoside that is consistent from batch to batch. Microorganisms described herein do not produce the undesired plant byproducts found in *Stevia* extracts. Thus, steviol glycoside compositions produced by the recombinant microorganisms described herein are distinguishable from compositions derived from *Stevia* plants.

V. Food Products

The steviol glycosides obtained by the methods disclosed herein can be used to make food products, dietary supplements and sweetener compositions. For example, substantially pure steviol or steviol glycoside such as rebaudioside A or rebaudioside D can be included in food products such as ice cream, carbonated beverages, fruit juices, yogurts, baked goods, chewing gums, hard and soft candies, and sauces. Substantially pure steviol or steviol glycoside can also be included in non-food products such as pharmaceutical products, medicinal products, dietary supplements and nutritional supplements. Substantially pure steviol or steviol glycosides may also be included in animal feed products for both the agriculture industry and the companion animal industry. Alternatively, a mixture of steviol and/or steviol glycosides can be made by culturing recombinant microorganisms separately or growing different plants/plant cells, each producing a specific steviol or steviol glycoside, recovering the steviol or steviol glycoside in substantially pure form from each microorganism or plant/plant cells and then combining the compounds to obtain a mixture containing each compound in the desired proportion. The recombinant microorganisms, plants, and plant cells described herein permit more precise and consistent mixtures to be obtained compared to current *Stevia* products. In another alternative, a substantially pure steviol or steviol glycoside can be incorporated into a food product along with other sweeteners, e.g. saccharin, dextrose, sucrose, fructose, erythritol, aspartame, sucralose, monatin, or acesulfame potassium. The weight ratio of steviol or steviol glycoside relative to other sweeteners can be varied as desired to achieve a satisfactory taste in the final food product. See, e.g., U.S. Patent Publication No. 2007/0128311. In some embodiments, the steviol or steviol glycoside may be provided with a flavor (e.g., citrus) as a flavor modulator. For example, Rebaudioside C can be used as a sweetness enhancer or sweetness modulator, in particular for carbohydrate based sweeteners, such that the amount of sugar can be reduced in the food product.

Compositions produced by a recombinant microorganism, plant, or plant cell described herein can be incorporated into food products. For example, a steviol glycoside composition produced by a recombinant microorganism, plant, or plant cell can be incorporated into a food product in an amount ranging from about 20 mg steviol glycoside/kg food product to about 1800 mg steviol glycoside/kg food product on a dry weight basis, depending on the type of steviol glycoside and food product. For example, a steviol glycoside composition produced by a recombinant microorganism, plant, or plant cell can be incorporated into a dessert, cold confectionary (e.g., ice cream), dairy product (e.g., yogurt), or beverage (e.g., a carbonated beverage) such that the food product has a maximum of 500 mg steviol glycoside/kg food on a dry weight basis. A steviol glycoside composition produced by a recombinant microorganism, plant, or plant cell can be incorporated into a baked good (e.g., a biscuit) such that the food product has a maximum of 300 mg steviol glycoside/kg food on a dry weight basis. A steviol glycoside composition produced by a recombinant microorganism, plant, or plant cell can be incorporated into a sauce (e.g., chocolate syrup) or vegetable product (e.g., pickles) such that the food product has a maximum of 1000 mg steviol glycoside/kg food on a dry weight basis. A steviol glycoside composition produced by a recombinant microorganism, plant, or plant cell can be incorporated into a bread such that the food product has a maximum of 160 mg steviol glycoside/kg food on a dry weight basis. A steviol glycoside composition produced by a recombinant microorganism, plant, or plant cell can be incorporated into a hard or soft candy such that the food product has a maximum of 1600 mg steviol glycoside/kg food on a dry weight basis. A steviol glycoside composition produced by a recombinant microorganism, plant, or plant cell can be incorporated into a processed fruit product (e.g., fruit juices, fruit filling, jams, and jellies) such that the food product has a maximum of 1000 mg steviol glycoside/kg food on a dry weight basis.

For example, such a steviol glycoside composition can have from 90-99% rebaudioside A and an undetectable amount of *stevia* plant-derived contaminants, and be incorporated into a food product at from 25-1600 mg/kg, e.g., 100-500 mg/kg, 25-100 mg/kg, 250-1000 mg/kg, 50-500 mg/kg or 500-1000 mg/kg on a dry weight basis.

Such a steviol glycoside composition can be a rebaudioside B-enriched composition having greater than 3% rebaudioside B and be incorporated into the food product such that the amount of rebaudioside B in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the rebaudioside B-enriched composition has an undetectable amount of *stevia* plant-derived contaminants.

Such a steviol glycoside composition can be a rebaudioside C-enriched composition having greater than 15% rebaudioside C and be incorporated into the food product such that the amount of rebaudioside C in the product is from 20-600 mg/kg, e.g., 100-600 mg/kg, 20-100 mg/kg, 20-95 mg/kg, 20-250 mg/kg, 50-75 mg/kg or 50-95 mg/kg on a dry weight basis. Typically, the rebaudioside C-enriched composition has an undetectable amount of *stevia* plant-derived contaminants.

Such a steviol glycoside composition can be a rebaudioside D-enriched composition having greater than 3% rebaudioside D and be incorporated into the food product such that the amount of rebaudioside D in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the rebaudioside D-enriched composition has an undetectable amount of *stevia* plant-derived contaminants.

Such a steviol glycoside composition can be a rebaudioside E-enriched composition having greater than 3% rebaudioside E and be incorporated into the food product such that the amount of rebaudioside E in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the rebaudioside E-enriched composition has an undetectable amount of *stevia* plant-derived contaminants.

Such a steviol glycoside composition can be a rebaudioside F-enriched composition having greater than 4% rebaudioside F and be incorporated into the food product such that the amount of rebaudioside F in the product is from 25-1000 mg/kg, e.g., 100-600 mg/kg, 25-100 mg/kg, 25-95 mg/kg, 50-75 mg/kg or 50-95 mg/kg on a dry weight basis. Typically, the rebaudioside F-enriched composition has an undetectable amount of *stevia* plant-derived contaminants.

Such a steviol glycoside composition can be a dulcoside A-enriched composition having greater than 4% dulcoside A and be incorporated into the food product such that the amount of dulcoside A in the product is from 25-1000 mg/kg, e.g., 100-600 mg/kg, 25-100 mg/kg, 25-95 mg/kg, 50-75 mg/kg or 50-95 mg/kg on a dry weight basis. Typically, the dulcoside A-enriched composition has an undetectable amount of *stevia* plant-derived contaminants.

Such a steviol glycoside composition can be a composition enriched for rubusoside xylosylated on either of the two positions—the 13-O-glucose or the 19-O-glucose. Such a composition can have greater than 4% of the xylosylated rubusoside compound, and can be incorporated into the food product such that the amount of xylosylated rubusoside compound in the product is from 25-1000 mg/kg, e.g., 100-600 mg/kg, 25-100 mg/kg, 25-95 mg/kg, 50-75 mg/kg or 50-95 mg/kg on a dry weight basis. Typically, the xylosylated rubusoside enriched composition has an undetectable amount of *stevia* plant-derived contaminants.

Such a steviol glycoside composition can be a composition enriched for compounds rhamnosylated on either of the two positions—the 13-O-glucose or the 19-O-glucose, or compounds containing one rhamnose and multiple glucoses (e.g., steviol 13-O-1,3-diglycoside-1,2-rhamnoside). Such a composition can have greater than 4% of the rhamnosylated compound, and can be incorporated into the food product such that the amount of rhamnosylated compound in the product is from 25-1000 mg/kg, e.g., 100-600 mg/kg, 25-100 mg/kg, 25-95 mg/kg, 50-75 mg/kg or 50-95 mg/kg on a dry weight basis. Typically, the composition enriched for rhamnosylated compounds has as an undetectable amount of *stevia* plant-derived contaminants.

In some embodiments, a substantially pure steviol or steviol glycoside is incorporated into a tabletop sweetener or "cup-for-cup" product. Such products typically are diluted to the appropriate sweetness level with one or more bulking agents, e.g., maltodextrins, known to those skilled in the art. Steviol glycoside compositions enriched for rebaudioside A, rebaudioside C, rebaudioside D, rebaudioside E, rebaudioside F, dulcoside A, or rhamnosylated or xylosylated compounds, can be package in a sachet, for example, at from 10,000 to 30,000 mg steviol glycoside/kg product on a dry weight basis, for tabletop use.

In some embodiments, this disclosure relates to the following items:

1. A recombinant host cell comprising a nucleic acid sequence, said nucleic acid comprising a heterologous insert sequence operably linked to an open reading frame, wherein the heterologous insert sequence has the general formula (I):

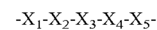

$$-X_1-X_2-X_3-X_4-X_5-$$

wherein $X_2$ comprises at least 4 consecutive nucleotides complementary to at least 4 consecutive nucleotides of $X_4$, wherein $X_3$ comprises zero nucleotides, or one or more nucleotides forming a hairpin loop, wherein $X_1$ and $X_5$ each individually consists of zero nucleotides, or one or more nucleotides, wherein the open reading frame encodes a squalene synthase (EC 2.5.1.21).

2. The recombinant cell according to item 1, said nucleic acid comprises in 5' to 3' order, a promoter sequence operably linked to a heterologous insert sequence operably linked to an open reading frame, wherein the heterologous insert sequence and the open reading frame are as defined in item 1.

3. A cell comprising a nucleic acid sequence, said nucleic acid comprising i) a promoter sequence operably linked to ii) a heterologous insert sequence operably linked to iii) an open reading frame operably linked to iv) a transcription termination signal, wherein the heterologous insert sequence has the general formula (I):

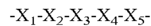

$$-X_1-X_2-X_3-X_4-X_5-$$

wherein $X_2$ comprises at least 4 consecutive nucleic acids being complementary to, and forms a hairpin secondary structure element with at least 4 consecutive nucleic acids of $X_4$, and wherein $X_3$ comprises unpaired nucleic acids thus forming a hairpin loop between $X_2$ and $X_4$, and wherein $X_1$ and $X_5$ individually and optionally comprises one or more nucleic acids, and wherein the open reading frame upon expression encodes a polypeptide sequence having at least 70% identity to a squalene synthase (EC 2.5.1.21) or a biologically active fragment thereof, said fragment having at least 70% sequence identity to said squalene synthase in a range of overlap of at least 100 amino acids.

4. The cell according to any one of items 1 to 3, wherein the heterologous insert sequence comprises 10-50 nucleotides, preferably 10-30 nucleotides, more preferably 15-25 nucleotides, more preferably 17-22 nucleotides, more preferably 18-21 nucleotides, more preferably 18-20 nucleotides, more preferably 19 nucleotides.

5. The cell according to any one of items 1 to 4, wherein $X_2$ and $X_4$ consists of the same number of nucleotides.

6. The cell according to any one of items 1 to 5, wherein all $X_2$ consists of in the range of 4 to 25, such as in the range of 4 to 20, for example of in the range of 4 to 15, such as in the range of 6 to 12, for example in the range of 8 to 12, such as in the range of 9 to 11 nucleotides.

7. The cell according to any one of items 1 to 6, wherein all $X_4$ consists of in the range of 4 to 25, such as in the range of 4 to 20, for example of in the range of 4 to 15, such as in the range of 6 to 12, for example in the range of 8 to 12, such as in the range of 9 to 11 nucleotides.

8. The cell according to any one of items 1 to 7, wherein $X_2$ consists of a nucleotide sequence, which is complementary to the nucleotide sequence of $X_4$.

9. The cell according to any one of items 1 to 8, wherein $X_4$ consists of a nucleotide sequence, which is complementary to the nucleotide sequence of $X_2$.

10. The cell according to any one of items 1 to 9, wherein $X_3$ is absent, i.e. $X_3$ consists of zero nucleotides.

11. The cell according to any one of items 1 to 9, wherein $X_3$ consists of in the range of 1 to 5, such as in the range of 1 to 3 nucleotides.

12. The cell according to any one of items 1 to 11, wherein $X_1$ is absent, i.e. $X_1$ consists of zero nucleotides.

13. The cell according to any one of items 1 to 11, wherein $X_1$ consists of in the range of 1 to 25, such as in the range of 1 to 20, for example in the range of 1 to 15, such as in the range of 1 to 10, for example in the range of 1 to 5, such as in the range of 1 to 3 nucleotides.

14. The cell according to any one items 1 to 13, wherein $X_5$ is absent, i.e. $X_5$ consists of zero nucleotides.

15. The cell according to any one of items 1 to 11, wherein $X_5$ consists of in the range 1 to 5, such as in the range of 1 to 3 nucleotides.

16. The cell according to any one of items 1 to 15, wherein the heterologous insert sequence comprises a sequence selected from the group consisting of SEQ ID NO: 181, SEQ ID NO: 182, SEQ ID NO: 183 and SEQ ID NO: 184.

17. The cell according to any one of items 1 to 16, wherein the heterologous insert sequence is selected from the group consisting of SEQ ID NO: 181, SEQ ID NO: 182, SEQ ID NO: 183 and SEQ ID NO: 184.

18. The cell according to any one of items 1 to 17, wherein the squalene synthase is at least 75%, such as at least 80%, such as at least 85%, such as at least 87%, such as at least 90%, such as at least 91%, such as at least 92%, such as at least 93%, such as at least 94%, such as at least 95%, such as at least 96%, such as at least 97%, such as at least 98%, such as at least 99%, such as 100% identical to a squalene synthase selected from the group consisting of SEQ ID NO: 192, SEQ ID NO:193, SEQ ID NO:194, SEQ ID NO:194, SEQ ID NO:195, SEQ ID NO:196, SEQ ID NO:197, SEQ ID NO:198, SEQ ID NO:199, SEQ ID NO:200, SEQ ID NO:201, and SEQ ID NO:202.

19. The cell according to any one of items 1 to 18, wherein said promoter is a constitutive or inducible promoter.

20. The cell according to any one of items 1 to 19, wherein said promoter is selected from the group consisting of an endogenous promoter, GPD1, PGK1, ADH1, ADH2, PYK1, TPI1, PDC1, TEF1, TEF2, FBA1, GAL1-10, CUP1, MET2, MET14, MET25, CYC1, GAL1-S, GAL1-L, TEF1, ADH1, CAG, CMV, human UbiC, RSV, EF-1alpha, SV40, Mt1, Tet-On, Tet-Off, Mo-MLV-LTR, Mx1, progesterone, RU486 and Rapamycin-inducible promoter.

21. The cell according to any one of items 1 to 20, wherein the nucleic acid sequence further comprises a polyadenyl sequence.

22. The cell according to item 21, wherein the 5' end of said polyadenyl sequence is operably linked to the 3' end of the nucleic acid of item 1.

23. The cell according to any one of items 1 to 22, wherein the nucleic acid sequence further comprises a post-transcriptional regulatory element.

24. The cell of item 23, wherein said post-transcriptional regulatory element is a Woodchuck hepatitis virus post-transcriptional regulatory element (WPRE).

25. The cell of any of items 1 to 24, wherein the nucleic acid comprises a 5' terminal repeat and a 3' terminal repeat.

26. The cell of item 25, wherein the 5' and 3' terminal repeats are selected from Inverted Terminal Repeats [ITR] and Long Terminal Repeats [LTR].

27. The cell according to any one of items 1 to 26, wherein the nucleic acid sequence is integrated in a vector.

28. The cell of item 27, wherein the vector is an expression vector.

29. The cell of item 27, wherein the vector is selected from the group consisting of plasmid vectors, cosmids, artificial chromosomes and viral vectors.

30. The cell of item 29 wherein the plasmid vector can be maintained and replicated in bacteria, fungi and yeast.

31. The cell of item 29, wherein the viral vector is selected from the group consisting of vectors derived from the Retroviridae family including lentivirus, HIV, SIV, FIV, EAIV, CIV.

32. The cell of item 31, wherein the viral vector is selected from the group consisting of alphavirus, adenovirus, adeno associated virus, baculovirus, HSV, coronavirus, Bovine papilloma virus, Mo-MLV and adeno associated virus.

33. The cell of any of items 27 to 32, wherein said vector is functional in mammalian cells.

34. The cell of any of the preceding items wherein the cell is transformed or transduced with the vector of any of the items 27 to 33.

35. The cell of any of items 1 to 34, wherein said cell is a eukaryotic cell.

36. The cell of any of items 1 to 34, wherein said cell is a prokaryotic cell.

37. The cell of item 35, wherein said cell is selected from the group consisting of fungi cells such as yeast and *aspergillus*; microalgae such as *Chlorella* and *Prototheca*; plant cells; and mammalian cells, such as human, feline, porcine, simian, canine, murine, rat, mouse and rabbit cells.

38 The cell of item 37, wherein the yeast is selected from the group consisting of *Saccharomyces cerevisiae, Schizosaccharomyces pombe, Yarrowia lipolytica, Candida glabrata, Ashbya gossypii, Cyberlindnera jadinii*, and *Candida albicans*.

39. The cell of item 37, wherein the cell is selected from the group consisting of CHO, CHO-K1, HEI193T, HEK293, COS, PC12, HiB5, RN33b, BHK cells.

40. The cell of item 36, wherein said cell is *E. coli, Corynebacterium, Bacillus, Pseudomonas* or *Streptomyces*.

41. The cell of any of items 35 to 40, wherein said prokaryotic cell, or said fungi cell, has been genetically modified to express at least a portion of the enzymes of the mevalonate independent pathway.

42. The cell according to any one of items 1 to 41, wherein the cell furthermore comprises a heterologous nucleic acid encoding GGPPS operably linked to a nucleic acid sequence directing expression of GGPPS in said cell.

43. The cell according to item 42, wherein said GGPPS is selected from the groups consisting of SEQ ID NO: 126, SEQ ID NO:123, SEQ ID NO:203, SEQ ID NO:167, and functional homologues thereof sharing at least 75% sequence identity with any of the aforementioned.

43. A method for producing a terpenoid compound synthesized through the squalene pathway, in a cell culture, said method comprising the steps of (a) providing the cell of any one of items 1 to 42, (b) culturing the cell of (a).

(c) recovering the terpenoid product compound.

44. A method for producing a terpenoid derived from a terpenoid precursor selected from the group consisting of Farnesyl-pyrophosphate (FPP), Isopentenyl-pyrophosphate (IPP), Dimethylallyl-pyrophosphate (DMAPP), Geranyl-pyrophosphate (GPP) and/or Geranylgeranyl-pyrophosphate (GGPP), said method comprising:

(a) contacting said precursor with an enzyme of the squalene synthase pathway, (b) recovering the terpenoid product.

45. The method of any of items 44 and 45, wherein the terpenoid product is selected from the group consisting of hemiterpenoids, monoterpenes, sesquiterpenoids, diterpenoids, sesterpenes, triterpenoids, tetraterpenoids and polyterpenoids.

46. The method of item 44, wherein the terpenoid is selected from the group consisting of farnesyl phosphate, farnesol, geranylgeranyl, geranylgeraniol, isoprene, prenol, isovaleric acid, geranyl pyrophosphate, eucalyptol, limonene, pinene, farnesyl pyrophosphate, artemisinin, bisabolol, geranylgeranyl pyrophosphate, retinol, retinal, phytol, taxol, forskolin, aphidicolin, lanosterol, lycopene and carotene.

47. The method of item 46, wherein said method further comprises dephosphorylating the farnesyl phosphate to produce farnesol.

48. The method of item 44, wherein the enzyme of the squalene synthase pathway is selected from the group consisting of Dimethylallyltransferase (EC 2.5.1.1), Isoprene synthase (EC 4.2.3.27) and Geranyltranstransferase (EC 2.5.1.10).

49. A method for reducing the translation rate of a functional squalene synthase (EC 2.5.1.21) said method comprising:

(a) providing the cell of any one of items 1 to 42, (b) culturing the cell of (a).

50. A method for decreasing turnover of farnesyl-pp to squalene, said method comprising:

(d) providing the cell of any one of items 1 to 42, (e) culturing the cell of (a).

51. A method for enhancing accumulation of a compound selected from the group consisting of Farnesyl-pyrophosphate, Isopentenyl-pyrophosphate, Dimethylallyl-pyrophosphate, Geranyl-pyrophosphate and Geranylgeranyl-pyrophosphate, said method comprising the steps of:

(a) providing the cell of any one of items 1 to 42, and (b) culturing the cell of (a).

52. The method of item 51, further comprising recovering the Farnesyl-pyrophosphate, Isopentenyl-pyrophosphate, Dimethylallyl-pyrophosphate, Geranyl-pyrophosphate or Geranylgeranyl-pyrophosphate compound.

53. The method of any one of items 51 and 52, further comprising recovering a compound synthesized through the squalene pathway, said compound being derived from said Farnesyl-pyrophosphate, Isopentenyl-pyrophosphate, Dimethylallyl-pyrophosphate, Geranyl-pyrophosphate and/or Geranylgeranyl-pyrophosphate.

54. The method of any of items 43 to 53, wherein the step of culturing the cell is performed in the presence of a squalene synthase inhibitor.

55. The method of any of items 43 to 54, wherein the cell additionally is genetically modified to enhance activity of and/or overexpress one or more enzymes selected from the group consisting of Phosphomevalonate kinase (EC 2.7.4.2), Diphosphomevalonate decarboxylase (EC 4.1.1.33), 4-hydroxy-3-methylbut-2-en-1-yl diphosphate synthase (EC 1.17.7.1), 4-hydroxy-3-methylbut-2-enyl diphosphate reductase (EC 1.17.1.2), Isopentenyl-diphosphate Delta-isomerase 1 (EC 5.3.3.2), Short-chain Z-isoprenyl diphosphate synthase (EC 2.5.1.68), Dimethylallyltransferase (EC 2.5.1.1), Geranyltranstransferase (EC 2.5.1.10) and Geranylgeranyl pyrophosphate synthetase (EC 2.5.1.29).

56. The method of any of items 43 to 55, wherein the cell additionally is genetically modified to enhance activity of and/or overexpress one or more enzymes selected from the group consisting of acetoacetyl CoA thiolose, HMG-CoA reductase or the catalytic domain thereof, HMG-CoA synthase, mevalonate kinase, phosphomevalonate kinase, phosphomevalonate decarboxylase, isopentenyl pyrophosphate isomerase, farnesyl pyrophosphate synthase, D-1-deoxyxylulose 5-phosphate synthase, and 1-deoxy-D-xylulose 5-phosphate reductoisomerase and farnesyl pyrophosphate synthase.

57. The method of any of items 43 to 56, wherein the cell comprises a mutation in the ERG9 open reading frame.

58. The method of any of items 43 to 57, wherein the cell comprises an ERG9[Delta]::HIS3 deletion/insertion allele.

59. The method of any of items 43 to 58, wherein the step of recovering the compound comprises purification of said compound from the cell culture media.

VI. Examples

The invention will be further described in the following examples, which do not limit the scope of the invention described in the claims. In the examples described herein, the following LC-MS methodology was used to analyze steviol glycosides and steviol pathway intermediates unless otherwise indicated.

1) Analyses of Steviol Glycosides

LC-MS analyses were performed using an Agilent 1200 Series HPLC system (Agilent Technologies, Wilmington, Del., USA) fitted with a Phenomenex® kinetex C18 column (150×2.1 mm, 2.6 μm particles, 100 Å pore size) connected to a TSQ Quantum Access (ThermoFisher Scientific) triple quadropole mass spectrometer with a heated electrospray ion (HESI) source. Elution was carried out using a mobile phase of eluent B (MeCN with 0.1% Formic acid) and eluent A (water with 0.1% Formic acid) by increasing the gradient from 10→40% B from min 0.0 to 1.0, increasing 40→50% B in min 1.0 to 6.5, 50→100% B from min 6.5 to 7.0 and finally washing and re-equilibration. The flow rate was 0.4 ml/min and the column temperature 30° C. The steviol glycosides were detected using SIM (Single Ion Monitoring) in positive mode with the following m/z-traces.

| Description | Exact Mass | m/z trace | compound (typical $t_R$ in min) |
|---|---|---|---|
| Steviol + 1 Glucose | $[M + H]^+$ 481.2796 $[M + Na]^+$ 503.2615 | 481.2 ± 0.5 503.1 ± 0.5 | 19-SMG (6.1), 13-SMG (6.4) |
| Steviol + 2 Glucose | $[M + Na]^+$ 665.3149 | 665 ± 0.5 | Rubusoside (4.7) Steviol-1,2-bioside (5.2) Steviol-1,3-bioside (5.8) |
| Steviol + 3 Glucose | $[M + Na]^+$ 827.3677 | 827.4 ± 0.5 | 1,2-Stevioside (4.0) 1,3-Stevioside (4.4) Rebaudioside B (5.0) |
| Steviol + 4 Glucose | $[M + Na]^+$ 989.4200 | 989.4 ± 0.5 | Rebaudioside A (3.9) |
| Steviol + 5 Glucose | $[M + Na]^+$ 1151.4728 | 1151.4 ± 0.5 | Rebaudioside D (3.3) |

The level of steviol glycosides were quantified by comparing with calibration curves obtained with authentic standards from LGC Standards. For example, standard solutions of 0.5 to 100 μM Rebaudioside A were typically utilized to construct a calibration curve.

2) Analyses of Steviol and Ent-Kaurenoic Acid

LC-MS analyses of steviol and ent-kaurenoic acid were performed on the system described above. For the separation, a Thermo Science Hypersil Gold (C-18, 3 μm, 100×2.1 mm) column was used and a 20 mM ammonium acetate aqueous solution was used as eluent A and acetonitrile as eluent B. The gradient conditions were: 20→55% B in min 0.0 to 1.0, 55→100 in min 1.0-7.0 and finally washing and re-equilibration. The flow rate was 0.5 mL/min and the column temperature 30° C. Steviol and ent-kaurenoic acid were detected using SIM (Single Ion Monitoring) in negative mode with the following m/z-traces.

| Description | Exact Mass | m/z trace | typical $t_R$ in min |
|---|---|---|---|
| Steviol | $[M - H]^-$ 317.2122 | 317.4 ± 0.5 | 3.3 |
| Ent-kaurenoic acid | $[M - H]^-$ 301.2173 | 301.4 ± 0.5 | 5.5 |

3) HPLC Quantification of UDP-Glucose

For the quantification of UDP-glucose, an Agilent 1200 Series HPLC system was used, with a Waters XBridge BEH amide (2.5 μm, 3.0×50 mm) column. Eluent A was a 10 mM ammonium acetate aqueous solution (pH 9.0) and Eluent B acetonitrile. The gradient conditions were: 95% B holding from min 0.0-0.5, decreasing from 95-50% B in min 0.5-4.5, holding 50% B from min 4.5-6.8 and finally re-equilibrating to 95% B. The flow rate was 0.9 mL/min and the column temperature 20° C. UDP-glucose was detected by $UV_{262nm}$ absorbance.

The amount of UDP-glucose was quantified by comparing with a calibration curve obtained with a commercially available standard (e.g., from Sigma Aldrich).

Example 1

Identification of EUGT11

Fifteen genes were tested for RebA 1,2-glycosylation activity. See Table 10.

TABLE 10

| Name | Source | GenBank Accession No. |
|---|---|---|
| EUGT2 | *Oryza sativa* UGT91 homolog | AP003270 |
| EUGT3 | *Oryza sativa* UGT91 homolog | AP005171 |
| EUGT4 | *Oryza sativa* UGT91 homolog | AP005643 |
| EUGT6 | *Oryza sativa* UGT91 homolog | AP005259 |
| EUGT7 | *Oryza sativa* UGT91 homolog | AP005171 |
| EUGT8 | *Oryza sativa* UGT91 homolog | XM_470006 |
| EUGT9 | *Oryza sativa* UGT91 homolog | AP005643 |
| EUGT10 | *Oryza sativa* UGT91 homolog | AC133334 |
| EUGT11 | *Oryza sativa* UGT91 homolog | AC133334 |
| EUGT12 | *Oryza sativa* UGT91 homolog | AC133334 |
| EUGT15 | *Petunia* × hybrid UGT79 homolog | Z25802 |
| EUGT16 | *Arabidopsis thaliana* UGT79 homolog | AC004786 |
| EUGT17 | *Dianthus caryophyllus* UGT79 homolog | AB294391 |
| EUGT18 | *Ipomoea nil* UGT79 homolog | AB192314 |
| EUGT19 | *Oryza sativa* UGT79 homolog | NM_001074394 |

Figure 4:
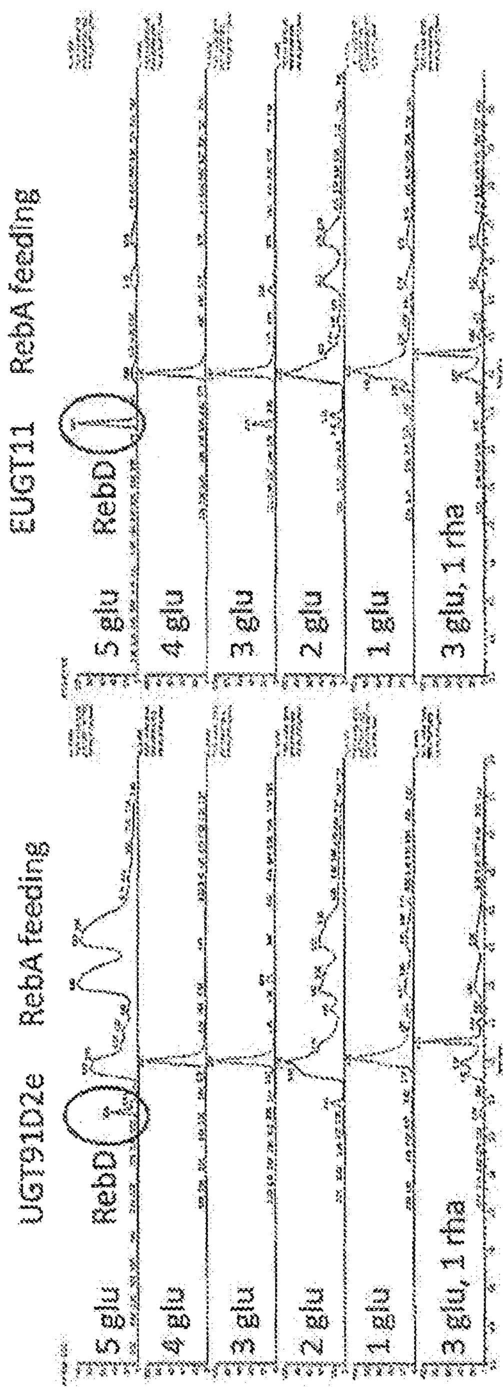

In vitro transcription and translation of these genes was performed, and the resulting UGTs incubated with RebA and UDP-glucose. Following incubation, the reactions were analyzed by LC-MS. The reaction mixture containing EUGT11 (Rice, AC133334, SEQ ID NO:152) was shown to convert significant quantities of RebA to RebD. See LC-MS chromatograms in FIG. 4. As shown in the left panel of FIG. 4, UGT91D2e produced a trace amount of RebD when RebA was used as the feedstock. As shown in the right panel of FIG. 4, EUGT11 produced a significant amount of RebD when RebA was used as the feedstock. Preliminary quantification of the amount of RebD that was produced indicated that EUGT11 was approximately 30 times more efficient than UGT91D2e at converting RebA to RebD.

To further characterize EUGT11 and for quantitative comparison to UGT91D2e, the nucleotide sequence encoding EUGT11 (SEQ ID NO: 153, non-codon optimized, FIG. 7) was cloned into two *E. coli* expression vectors, one containing an N-terminal HIS-tag and one containing an N-terminal GST-tag. EUGT11 was expressed using both systems and purified. When the purified enzymes were incubated with UDP-glucose and RebA, RebD was produced.

Example 2

Identification of EUGT11 Reactions

EUGT11 was produced by in vitro transcription and translation, and incubated with various substrates in the RebD pathway. Similar experiments were carried out using in vitro transcribed and translated UGT91D2e. FIG. 3 shows a schematic overview of 19-O-1,2-diglycosylation reactions performed by EUGT11 and UGT91D2e. Compounds 1-3 were identified solely by mass and expected retention time. The numbers shown in FIG. 3 are the average peak height of the indicated steviol glycoside obtained from a LC-MS chromatogram, and, although not quantitative, can be used to compare the activity of the two enzymes. EUGT11 and UGT91D2e were not able to use steviol as a substrate. Both enzymes were able to convert steviol 19-O-monoglucoside (SMG) to compound 1, with EUGT11 being about ten times more efficient than UGT91D2e at converting 19-SMG to compound 1.

Figure 5:
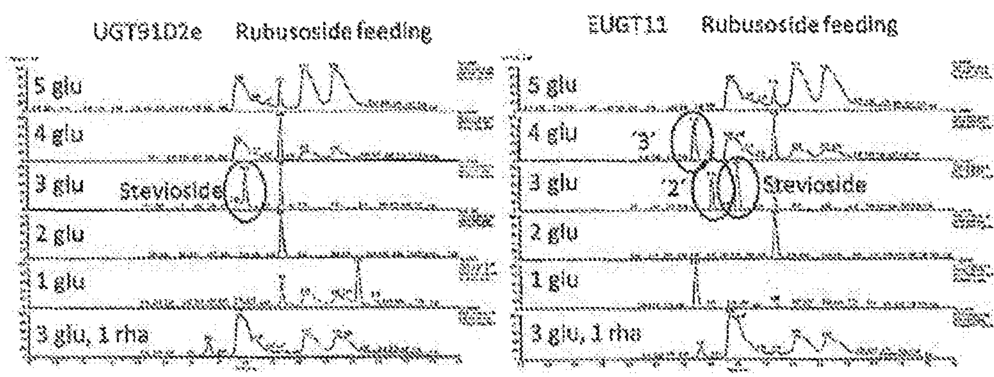
FIG. 5 contains LC-MS chromatograms showing the conversion of rubusoside to stevioside and compounds ‘2’ and ‘3’ (RebE) by UGT91D2e (left panel) and EUGT11 (right panel).

Both enzymes were able to convert rubusoside to stevioside with comparable activity but only EUGT11 was able to convert rubusoside to compound 2 and compound 3 (RebE). See FIG. 5. The left panel of FIG. 5 contains LC-MS chromatograms of the conversion of rubusoside to stevioside. The right panel of FIG. 5 contains chromatograms of the conversion of rubusoside to stevioside, to compound 2, and to compound 3 (RebE). Conversion of rubusoside to compound 3 requires two consecutive 1,2-O-glycosylations at the 19- and 13-positions of steviol. UGT91D2e was able to produce a trace amount of compound 3 (RebE) in one experiment whereas EUGT11 produced a significant amount of compound 3.

Both enzymes were able to convert RebA to RebD. However, EUGT11 was approximately 30 times better at converting RebA to RebD. Overall, it appears that EUGT11 produces more product than UGT91D2e in all reactions (with similar time, concentrations, temperature, and purity of enzyme) except the conversion of rubusoside to stevioside.

Example 3

Expression of EUGT11 in Yeast

The nucleotide sequence encoding EUGT11 was codon-optimized (SEQ ID NO:154) and transformed into yeast along with nucleic acids encoding all four UGTs (UGT91D2e, UGT74G1, UGT76G1, and UGT85C2). The resulting yeast strain was grown in medium containing steviol and steviol glycosides that accumulated were analyzed by LC-MS. EUGT11 was required for the production of RebD. In other experiments, RebD production has been observed with UGT91D2e, UGT74G1, UGT76G1, and UGT85C2.

Example 4

UGT Activity on 19-O-1,2-Diglycosylated Steviol Glycosides

The 19-O-1,2-diglycosylated steviol glycosides produced by EUGT11 need further glycosylation to be converted to RebD. The following experiments were performed to determine if other UGTs could use these intermediates as substrates.

In one experiment, compound 1 was produced in vitro from 19-SMG by either EUGT11 or UGT91D2e in the presence of UDP-glucose. After boiling the sample, UGT85C2 and UDP-glucose were added. The sample was analyzed by LC-MS and compound 2 was detected. This experiment indicated that UGT85C2 can use compound 1 as a substrate.

In another experiment, compound 2 was incubated with UGT91D2e and UDP-glucose. The reaction was analyzed by LC-MS. UGT91D2e was not able to convert compound 2 to compound 3 (RebE). Incubation of compound 2 with EUGT11 and UDP-glucose results in the production of compound 3. UGT76G1 was able to use RebE as a substrate to produce RebD.

This shows that the 19-O-1,2-diglycosylation of the steviol glycosides is able to take place at any time during production of RebD as the downstream enzymes are able to metabolize the 19-O-1,2-diglycosylated intermediates.

Example 5

Comparison of EUGT11 and UGT91D2e Sequence

The amino acid sequence of EUGT11 (SEQ ID NO:152, FIG. 7) and the amino acid sequence of UGT91D2e (SEQ ID NO:5) were aligned using the FASTA algorithm (Pearson and Lipman, *Proc. Natl. Acad. Sci.,* 85:2444-2448 (1998)). See FIG. 6. EUGT11 and UGT91D2e are 42.7% identical over 457 amino acids.

Example 6

Modification of 19-1,2-Diglycosylating Activity of UGT91D2e

Crystal structures are available for a number of UGTs. Generally, the N-terminal half of a UGT is primarily involved with substrate binding whereas the C-terminal half is involved in binding the UDP-sugar donor.

Figure 8:
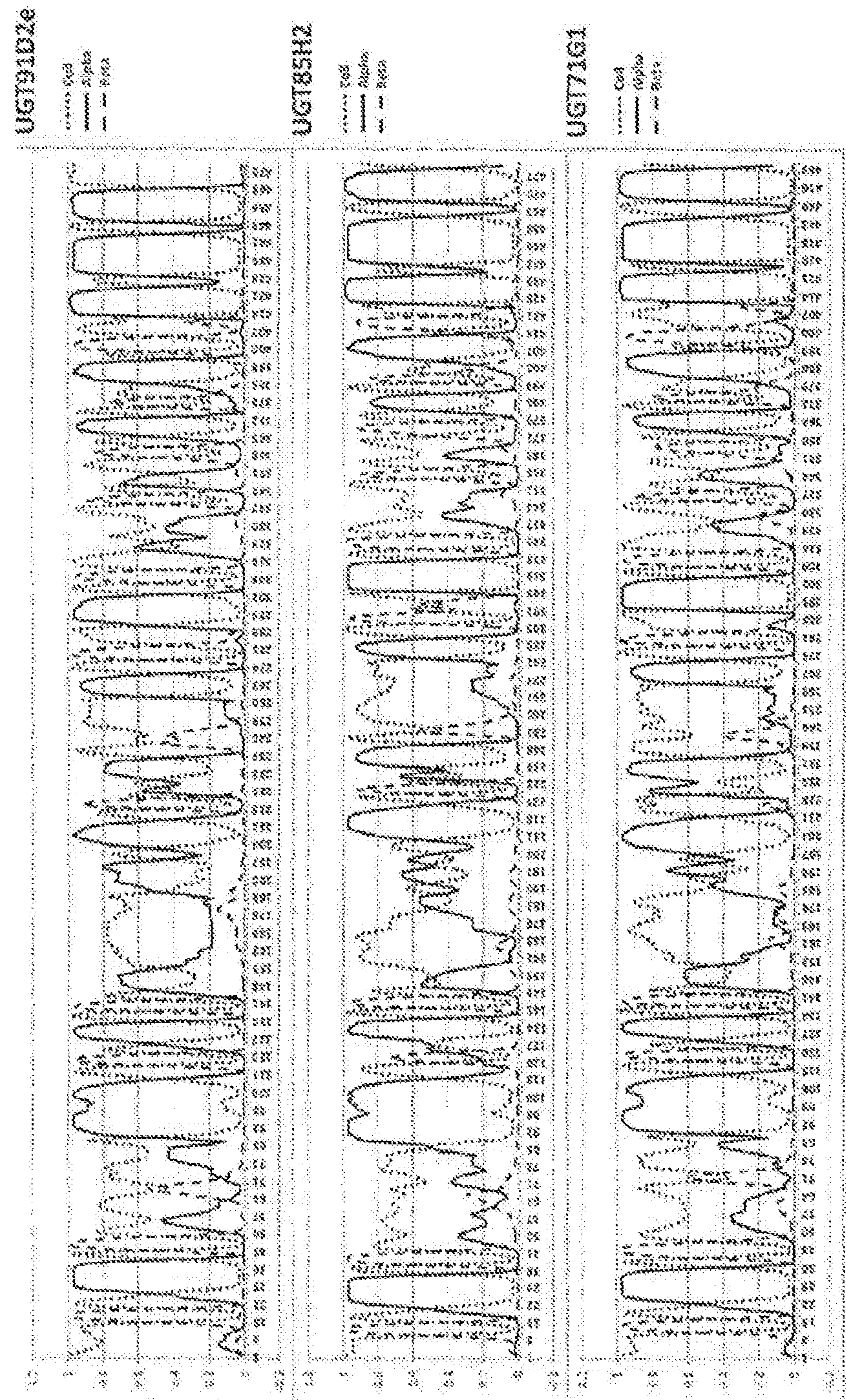
FIG. 8 is an alignment of the secondary structure predictions of UGT91D2e with UGT85H2 and UGT71G1. Secondary structure predictions were made by subjecting the amino acid sequences of the three UGTs to NetSurfP ver. 1.1—Protein Surface Accessibility and Secondary Structure Predictions, at the world wide web at cbs.dtu.dk/services/NetSurfP/. This predicted the presence and location of alpha helices, beta sheets and coils in the proteins. These were subsequently labeled as shown for UGT91D2e. For example, the first N-terminal beta-sheet was labeled Nβ1. The y-axis represents the certainty of the prediction, the higher the more confident and the x-axis represents amino acid position. Although the primary sequence identity between these UGTs is very low, the secondary structures show a very high degree of conservation.

Modeling the secondary structure of UGT91D2e onto the secondary structure of the UGTs that have been crystallized revealed a conserved pattern of secondary structure, despite a highly diverged primary sequence as shown in FIG. 8. The crystal structures of UGT71G1 and UGT85H2 (see, for example H. Shao et al, *The Plant Cell* November 2005 vol. 17 no 11 3141-3154 and L. Li et al., *J Mol. Biol.* 2007 370(5):951-63) have been reported. Known loops, alpha-helices and beta-sheets are indicated on UGT91D2e in FIG. 8. Although the homology at the primary structure level of these UGTs is fairly low, the secondary structure appears to be conserved, allowing predictions regarding the locations of amino acids involved in substrate binding on UGT91D2e based on the location of such amino acids in UGT85H2 and UGT71G1.

Regions commonly involved in substrate binding were superimposed on UGT91D2e and largely shown to coincide with the 22 amino acid differences from UGT91D1 (GenBank Accession No. Protein Accession number AAR06918, GI:37993665). UGT91D1 is highly expressed in *Stevia* and thought to be a functional UGT. However, its substrate is not a steviol glycoside. This suggests that UGT91D1 has a different substrate, which may be defined by the 22 amino acids with which it differs from UGT91D2e. FIG. 9 is an alignment of the amino acid sequences of UGT91D1 and UGT91D2e. The boxes represent areas that are reported to be involved in substrate binding. The amino acids highlighted in dark grey show the 22 amino acid differences between UGT91D1 and UGT91D2e. Stars denote amino acids that have been shown to be involved in substrate binding in UGTs that have had their crystal structure resolved (more stars under one particular amino acids means substrate binding has been shown with more than one structure-resolved UGTs). There is a strong correlation between the 22 amino acid differences between the two UGT91s, the regions known to be involved in substrate binding, and the actual amino acids involved in substrate binding in the crystal structure-resolved UGTs. This suggests that the 22 amino acid differences between the two UGT91s are involved in substrate binding.

All 22 altered 91D2es were expressed in a XJb Autolysis *E. coli* strain from a pGEX-4T1 vector. In order to assess the activity of the enzymes, two substrate feeding experiments were performed—in vivo and in vitro. Most mutants had lower activity than wild type, however, 5 mutants showed increased activity. This was reproduced by in vitro transcription and translation (IVT) and showed that C583A, C631A and T857C have approximately 3-fold higher stevioside-forming activity than the wild-type UGT91D2e, whereas C662t and A1313C had approximately twice the stevioside-forming activity (nucleotide numbering). These changes result in amino acid mutations corresponding to L195M, L211M, V286A; and S221F and E438A, respectively. The increased activity differed depending on substrate, with C583A and C631A showing almost a 10-fold increase using 13-SMG as substrate and about a 3-fold increase using rubusoside as substrate, whereas T857C showed a 3-fold increase when using either 13-SMG or rubusoside as substrate.

Figure 10:
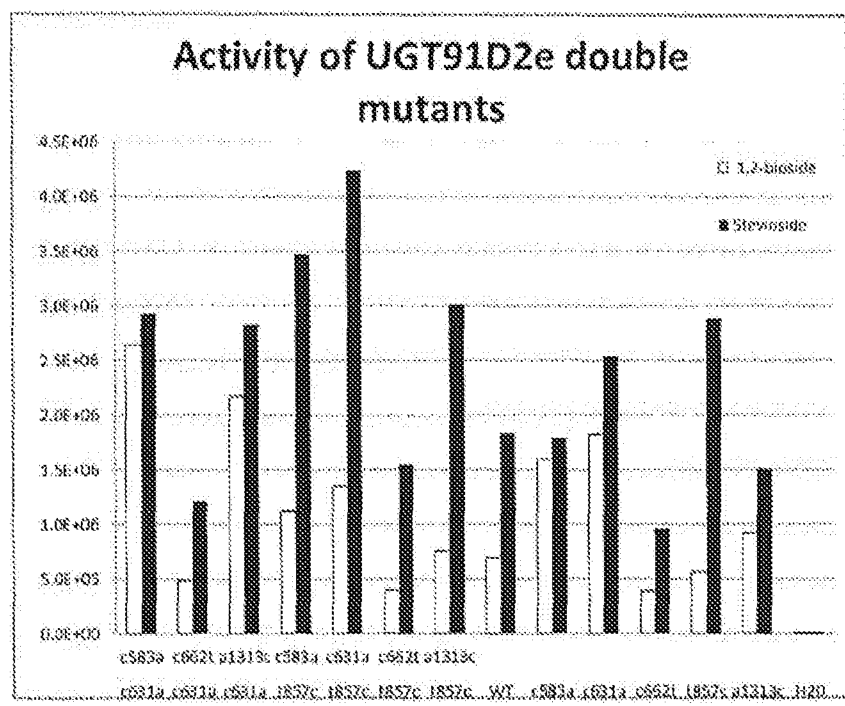
FIG. 10 is a bar graph of the activity of double amino acid substitution mutants of UGT91D2e. The filled bars represent stevioside production and the open bars represent 1,2-bioside production.

To investigate if these mutations were additive, a range of double mutants were made and analyzed for activity (FIG. 10). In this particular experiment, a higher wild type level of activity was observed than the previous four experiments; however, the relative activities of the mutations remain the same. As rubusoside accumulates in many of the *S. cerevisiae* strains expressing the 4 UGTs (UGT74G1, UGT85C2, UGT76G1, and UGT91D2e), the stevioside-forming activity may be more important for increasing steviol glycoside production. As such, the double mutant C631A/T857C (nucleotide numbering) may be useful—This mutant has been named UGT91D2e-b, which contains the amino acid modifications L211M and V286A. The experiments have been reproduced in vitro using *S. cerevisiae*-expressed UGT91D2e-mutants.

To improve 19-1,2-diglycosylating activity of UGT91D2e, a directed saturated mutagenic screen of UGT91D2e of the 22 amino acid differences between UGT91D2e and UGT91D1 was performed. GeneArt's® (Life Technologies, Carlsbad, Calif.) site-saturation mutagenesis was used to obtain a library containing each of the mutations. The library was cloned into the BamHI and NotI sites of pGEX4T1 bacterial expression plasmid expressing the mutated versions of 91D2e as GST fusion proteins, resulting in a new library (Lib#116). Lib#116 was transformed into XJbAutolysis *E. coli* strain (ZymoResearch, Orange, Calif.) to produce approximately 1600 clones containing the 418 expected mutations (i.e., 22 positions with 19 different amino acids at each position). Other plasmids expressing GST-tagged versions of 91D2e (EPCS1314), 91D2e-b (EPSC1888) or EUGT11 (EPSC1744) as well as the empty $pGEX_4T1$ (PSB12) were transformed as well.

Screening by LC-MS

To analyze the approximately 1600 mutant clones of UGT91D2e, the *E. coli* transformants were grown overnight at 30° C. in 1 ml of NZCYM containing ampicillin (100 mg/l) and chloramphenicol (33 mg/l), in 96-well format. The next day, 150 μl of each culture was inoculated into 3 ml NZCYM containing ampicillin (100 mg/l), chloramphenicol (33 mg/l), arabinose 3 mM, IPTG 0.1 mM and ethanol 2% v/v, in 24-well format, and incubated at 20° C. and 200 rpm for ~20 h. The following day, cells were spun down and pellets were resuspended in 100 μl of lysis buffer containing 10 mM Tris-HCl pH 8, 5 mM $MgCl_2$, 1 mM $CaCl_2$ and complete mini protease inhibitor EDTA-free (3 tablets/100 ml) (Hoffmann-La Roche, Basel, Switzerland) and frozen −80° C. for at least 15 minutes to promote cell lysis. Pellets were thawed at room temperature and 50 μl of DNase mix (1 μl of 1.4 mg/ml DNase in H2O (~80000u/ml), 1.2 μl of $MgCl_2$ 500 mM and 47.8 μl of 4×PBS buffer solution) was added to each well. Plates were shaken at 500 rpm for 5 min at room temperature to allow degradation of genomic DNA. Plates were spun down at 4000 rpm for 30 min at 4° C. and six μl of the lysates were used in UGT in vitro reactions as described for GST-91D2e-b, using rubusoside or rebaudioside A as substrates. In each case, the resulting compounds, stevioside or rebaudioside D (rebD), were measured by LC-MS. Results were analyzed in comparison with the stevioside or rebD produced by the lysates expressing the corresponding controls (91D2e, 91D2e-b, EUGT11 and the empty plasmid). Clones showing activity similar to or higher than the ones expressing 91D2e-b were selected as primary hits.

Half of the 1600 clones and the corresponding controls were assayed for their capacity to glycosylate rubusoside and rebaudiosideA. Stevioside and RebD were quantified by LC-MS. Under the conditions used, lysates from clones expressing the native UGT91D2e show activity just around background with both substrates (approximately 0.5 μM. stevioside and 1 μM RebD), while clones expressing UGT91D2e-b show consistently improved product formation (>10 μM Stevioside; >1.5 μM RebD). Clones expressing EUGT11 consistently display a higher level of activity, especially using RebA as substrate. Cutoff for considering clones as primary hits in the screening was generally set at 1.5 μM for both products, but in some cases was adjusted for each independent assay.

Example 7

EUGT11 Homologs

A Blastp search of the NCBI nr database using the EUGT11 protein sequence revealed approximately 79 potential UGT homologs from 14 plant species (one of which is the *Stevia* UGT91D1, approximately 67% identical to EUGT11 in conserved UGT regions but less than 45% overall). Homologs with greater than 90% identity in conserved regions were identified from corn, soybean, *Arabidopsis*, grape, and *Sorghum*. The overall homology of the full-length EUGT11 homologs, at the amino acid level, was only 28-68%.

RNA was extracted from plant material by the method described by Iandolino et al. (Iandolino et al., *Plant Mol Biol Reporter* 22, 269-278, 2004), the RNeasy Plant mini Kit (Qiagen) according to the manufacturer's instructions, or using the Fast RNA Pro Green Kit (MP Biomedicals) according to the manufacturer's instructions. cDNA was produced by AffinityScript QPCR cDNA Synthesis Kit (Agilent) according to the manufacturer's instructions.

Genomic DNA was extracted using the FastDNA kit (MP biomedicals) according to the manufacturer's instructions. PCR was performed on cDNA using either the Dream Taq polymerase (Fermentas) or the Phusion polymerase (New England Biolabs) and a series of primers designed to amplify the homologs.

PCR-reactions were analyzed by electrophoresis in SyberSafe-containing agarose-TAE gels. DNA was visualized by UV-irradiation in a trans illuminator. Bands of the correct size were cut out, purified through spin columns according to the manufacturer's specifications, and cloned into TOPO-Zero blunt (for Phusion polymerase-generated products) or TOPO-TA (for Dream Taq-generated products). The TOPO-vectors containing the PCR-products were transformed into *E. coli* DH5Bα and plated on LB-agar plates containing the appropriate selective antibiotics. DNA was extracted from surviving colonies and sequenced. The genes with the correct sequence were cut out by restriction digest with SbfI and AscI, cloned into similarly digested IVT8 vector and transformed into *E. coli*. PCRs were performed on all cloned genes to amplify the gene and flanking regions required for in vitro transcription and translation. Proteins were produced from the PCR products by in vitro transcription and translation using the Promega L5540, TNT T7 Quick for PCR DNA Kit according to the manufacturer's instructions. Production of protein was evaluated by incorporation of $^{35}$S-methionine followed by separation by SDS-PAGE and visualization on a Typhoon phosphor-imager.

Activity assays were set up totaling 20% (by volume) of each in vitro reaction, 0.1 mM rubusoside or RebA, 5% DMSO, 100 mM Tris-HCl pH 7.0, 0.01 units Fast alkaline phosphatase (Fermentas), and 0.3 mM UDP-glucose (final concentrations). Following incubation at 30° C. for one hour, the samples were analyzed by LC-MS for production of stevioside and RebD as described above. The UGT91D2e and UGT91D2e-b (double mutant described in Example 6) were used as positive controls, along with EUGT11. Under the initial assay conditions, clone P 64B (see Table 11) produced a trace amount of product using rubusoside and RebA. Table 11 lists the percent identity at the amino acid level compared to EUGT11 for the whole length of the UGTs, which ranges from 28-58%. High amounts of homology (96-100%) were observed over shorter stretches of sequences, which may indicate highly conserved domains of plant UGTs.

TABLE 11

List of cloned EUGT11 homologs and their amino acid percent identity to EUGT11.

| UGT | Accession | % identity to EUGT11 |
|---|---|---|
| P44G | XP_002297733.1 | 32.16 |
| P54A | XP_002532392.1 | 34.20 |
| P51H | XP_002325254.1 | 32.53 |
| P55D | XP_002533517.1 | 31.90 |
| P5F | AAM12787.1 | 31.73 |
| P48G | XP_002318358.1 | 33.20 |
| P52F | XP_002334090.1 | 32.80 |
| P48F | XP_002318358.1 | 33.00 |
| T4B-b | NP_565540.4 | 31.19 |
| P56C | XP_002533518.1 | 32.60 |
| T67H | XP_002270294.1 | 34.06 |
| T65E | CAN80742.1 | 34.98 |
| T74G | XP_002270331.1 | 35.48 |
| T65D | CAN80742.1 | 34.98 |
| T69F1 | XP_003635103.1 | 34.69 |
| P6B | Q66PF2.1 | 33.20 |

TABLE 11-continued

List of cloned EUGT11 homologs and their amino acid percent identity to EUGT11.

| UGT | Accession | % identity to EUGT11 |
|---|---|---|
| P6D variant | Q66PF2.1 | 33.60 |
| P64B | ACE87855.1 | 34.64 |
| T3F | AT5G65550 | 34.94 |
| P53H | XP_002527371.1 | 33.40 |
| P53F | XP_002527371.1 | 33.40 |
| P46H | XP_002303861.1 | 32.40 |
| 2-b | NP_199780.1 | 35.79 |
| T70F | XP_002275802.1 | 36.67 |
| T72A | XP_002275850.1 | 36.42 |
| T71G | XP_002275824.1 | 37.25 |
| P49G | XP_002320817.1 | 35.15 |
| P57H | XP_002511902.1 | 36.23 |
| 45 Pop | XP_002302598.1 | 34.21 |
| P50G | XP_002323718.1 | 32.86 |
| P50H | XP_002323718.1 | 32.66 |
| T73G | XP_002281094.1 | 32.05 |
| 63 | XP_002458816.1 | 37.25 |
| P78B | NP_001147674.1 | 35.33 |
| 62 | XP_002458815.1 | 34.06 |
| P9F | BAJ84800.1 | 37.92 |
| T7H | NP_001240857.1 | 31.30 |
| 16-1 | BAJ93155.1 | 58.03 |
| T16H | BAJ93155.1 | 58.03 |
| 31TA | BAD35324.1 | 51.81 |
| P41G | NP_001174664.1 | 35.40 |
| P37G | NP_001051010.1 | 56.71 |
| P60aH | XP_002466606.1 | 57.35 |
| 12 | BAJ89368.1 | 44.35 |
| P12A | BAJ89368.1 | 44.35 |
| P12H | BAJ89368.1 | 44.35 |
| P10B | BAJ86656.1 | 45.16 |
| P58aF | XP_002463702.1 | 43.71 |
| P59aG | XP_002463705.1 | 43.51 |
| P76H | NP_001140711.1 | 28.81 |

Example 8

Cell-free Biocatalytic Production of Reb-D

The cell-free approach is an in vitro system where RebA, stevioside or a steviol glycoside mixture is enzymatically converted to RebD. The system requires stoichiometric amounts of UDP-glucose and therefore UDP-glucose regeneration from UDP and sucrose using sucrose synthase can be used. Additionally, sucrose synthase removes UDP produced during the reaction, which improves conversion to glycosylated products by alleviated product inhibition observed for glycosylation reactions. See, WO 2011/153378.

Enzyme Expression and Purification

UGT91D2e-b (described in Example 6) and EUGT11 are key enzymes that catalyze the glycosylation of RebA yielding RebD. These UGTs were expressed in bacteria (*E. coli*) but one of ordinary skill in the art will appreciate that such proteins also can be prepared using different methods and hosts (e.g., other bacteria such as *Bacillus* sp., yeast such as *Pichia* sp. or *Saccharomyces* sp., other fungi (e.g., *Aspergillus*), or other organisms). For example, the proteins can be produced by in vitro transcription and translation or by protein synthesis.

The UGT91D2e-b and EUGT11 genes were cloned in pET30a or pGEX4T1 plasmids. Resulting vectors were transformed into an XJb (DE3) Autolysis *E. coli* strain (ZymoResearch, Orange, Calif.). Initially, *E. coli* transformants were grown overnight at 30° C. in NZCYM medium, followed by induction with 3 mM arabinose and 0.1 mM IPTG, and further incubation overnight at 30° C. The corresponding fusion proteins were purified by affinity chromatography using included 6HIS- or GST-tags and standard methods. One skilled in the art will appreciate that other protein purification methods such as gel filtration or other chromatography techniques also can be used, along with precipitation/crystallization or fractionation with e.g., ammonium sulfate. While EUGT11 was expressed well using the initial conditions, UGT91D2e-b required several modifications to the base protocol to increase protein solubility, including lowering the temperature of the overnight expression from 30° C. to 20° C. and adding 2% ethanol to the expression medium. Generally 2-4 mg/L of soluble GST-EUGT11 and 400-800 μg/1 of GST-UGT91D2e-b were purified with this method.

Stability of EUGT11

Reactions were conducted to explore the stability of EUGT11 under various RebA to RebD reaction conditions. Omitting the substrate from the reaction mixture, EUGT11 was pre-incubated for various periods of time before substrate was added. Following a pre-incubation of the enzyme in 100 mM Tris-HCl buffer, substrate (100 μM RebA) and other reaction components (300 μM UDP-glucose, and 10 U/mL Alkaline Phosphatase (Fermentas/Thermo Fisher, Waltham, Mass.)) were added (0, 1, 4 or 24 hours after the incubation was started). The reaction was then allowed to proceed for 20 h, after which the reactions were stopped and RebD product-formation measured. Experiments were repeated at different temperatures: 30° C., 32.7° C., 35.8° C. and 37° C.

The activity of EUGT11 was reduced rapidly when the enzyme was pre-incubated at 37° C., reaching approximately half activity after 1 hour, and having almost no activity after 4 hours. At 30° C., the activity was not significantly reduced after 4 hours and after 24 hours, approximately one-third of the activity remained. This suggests that EUGT11 is heat-labile.

To assess the thermal stability of EUGT11 and to compare it with the other UGTs in the steviol glycosylation pathway, denaturation temperatures of the proteins were determined using differential scanning calorimetry (DSC). Use of DSC thermograms to estimate denaturation temperatures, $T_D$, is described, for example, by E. Freire in *Methods in Molecular Biology* 1995, Vol. 40 191-218. DSC was performed using 6HIS-purified EUGT11, yielding an apparent $T_D$ of 39° C.; while when GST-purified 91D2e-b was used, the measured $T_D$ was 79° C. For reference, the measured $T_D$ when using 6HIS-purified UGT74G1, UGT76G1 and UGT85C2 was 86° C. in all cases. One of skill in the art will recognize that enzyme immobilization or addition of thermal protectants can be added to the reactions to improve stability of the protein. Non-limiting examples of thermal protectants include trehalose, glycerol, ammonium sulphate, betaine, trimethylamine oxide, and proteins.

Enzyme Kinetics

A series of experiments were performed to determine kinetic parameters of EUGT11 and 91D2e-b. For both enzymes, 100 μM RebA, 300 μM UDP-glucose, and 10 U/mL Alkaline Phosphatase (Fermentas/Thermo Fisher, Waltham, Mass.) were used in the reactions. For EUGT11, the reactions were performed at 37° C. using 100 mM Tris-HCl, pH 7, and 2% enzyme. For 91D2e-b, the reactions were performed at 30° C. using 20 mM Hepes-NaOH, pH 7.6, 20% (by volume) enzyme. The initial velocities ($V_0$) were calculated in the linear range of a product versus time plot.

To first investigate the linearity intervals, initial time-courses were done for each enzyme. EUGT11 was assayed at 37° C. for 48 h at initial concentrations of 100 μM RebA and 300 μM UDP-glucose. UGT91D2e-b was assayed at 37° C. for 24 h at initial concentrations of 200 μM RebA and 600 μM UDP-glucose. Based on these range-finding studies, it was determined that the initial 10 minutes in the case of EUGT11, and the initial 20 minutes in UGT91D2e-b would be in the linear range with respect to product formation, and therefore initial velocities of each reaction were calculated in those intervals. In the case of EUGT11, RebA concentrations assayed were 30 μM, 50 μM, 100 μM, 200 μM, 300 μM and 500 μM. Concentration of UDP-glucose was always three times the concentration of RebA and incubation was performed at 37° C. By plotting the calculated $V_0$ as a function of the substrate concentrations, Michaelis-Menten curves were generated. By plotting the reciprocal of $V_0$ and the reciprocal of [S], a Lineweaver-Burk graphic was obtained, with $y=339.85x+1.8644$; $R^2=0.9759$.

$V_{max}$ and $K_M$ parameters were determined from the curve-fit Lineweaver-Burk data, calculated from the x- and y intercepts ($x=0$, $y=1/V_{max}$) and ($y=0$, $x=-1/K_M$). Additionally, the same parameters also were calculated by a non-linear least squares regression, using the SOLVER function in Excel. The results obtained with both methods for EUGT11 and RebA are presented in Table 12, along with all the kinetic parameters of this example. Results from both Nonlinear Least Square Fit method and Lineweaver-Burk plot are presented in Table 12. $K_{cat}$ is calculated based on $V_{max}$ divided by the approximate amount of protein in the assay.

TABLE 12

Comparison of kinetic parameters for EUGT11 and UGT 91D2e-b, with RebA or UDP-glucose as substrate.

| | Nonlinear Least Square Fit | | | | Lineweaver-Burk plot | | | |
|---|---|---|---|---|---|---|---|---|
| | Reb A | | UDP-glucose | | Reb A | | UDP-glucose | |
| | EUGT11 | 91D2e-b | EUGT11 | 91D2e-b | EUGT11 | 91D2e-b | EUGT11 | 91D2e-b |
| $V_{max}$ (μM · min$^{-1}$) | 0.52 | 0.34 | 0.79 | 0.19 | 0.54 | 0.44 | 0.78 | 0.18 |
| $K_{cat}$ (min$^{-1}$) | 8.11 | 0.32 | 12.32 | 0.2 | 8.42 | 0.41 | 12.1 | 0.19 |
| $K_M$ (μM) | 162.5 | 1150 | 130 | 45.1 | 182.3 | 1580 | 118 | 41.9 |
| $K_{cat}/K_M$ (min$^{-1}$ · μM$^{-1}$) | 0.05 | 0.000275 | 0.095 | 0.00454 | 0.046 | 0.000258 | 0.102 | 0.00463 |

In order to investigate the influence of UDP-glucose concentration in the glycosylation reaction, as well as the affinity of EUGT11 for UDP-glucose, similar kinetics analysis were performed. EUGT11 was incubated with increasing amounts of UDP-glucose (20 μM, 50 μM, 100 μM, and 200 μM), maintaining an excess of RebA (500 μM). The kinetic parameters were calculated as described above, and shown in Table 12.

In the case of UGT91D2e-b, RebA concentrations assayed were 50 μM, 100 μM, 200 μM, 300 μM, 400 μM and 500 μM. Concentration of UDP-glucose was always three times the concentration of RebA and incubation was performed at 30° C., in the reaction conditions described above for UGT91D2e-b. The kinetic parameters were calculated as previously described; and the resulting kinetic parameters are shown in Table 12. Additionally, kinetic parameters of UGT91D2e-b towards UDP-glucose were determined. UGT91D2e-b was incubated with increasing amounts of UDP-glucose (30 μM, 50 μM, 100 μM, and 200 μM), maintaining an excess of RebA (1500 μM). incubation was performed at 30° C., in optimal conditions for UGT91D2e-b. The kinetic parameters were calculated as previously described and results are presented in Table 12.

By comparison of the kinetics parameters for EUGT11 and 91D2e-b, it was concluded that 91D2e-b has a lower $K_{cat}$ and has lower affinity for RebA (higher $K_M$) although the $K_M$ for UDP-glucose of 91D2e-b is lower than EUGT11. UGT91D2e-b has a lower $K_{cat}/K_M$ which is a measure of catalytic efficiency, combining information on rate of catalysis with a particular substrate (Kcat) and the strength of enzyme-substrate binding ($K_M$).

Determining the Limiting Factor in Reactions

Under the conditions described above for EUGT11, approximately 25% of the RebA administered was converted to RebD. The limiting factor in these conditions could be either the enzyme, UDP-glucose or RebA. Experiments were set up to distinguish between these possibilities. A standard assay was allowed to run its course during 4 hours. This was followed by addition of either extra RebA substrate, extra enzyme, extra UDP-glucose or extra enzyme and UDP-glucose. Addition of extra enzyme resulted in a relative increase of the conversion of around 50%, adding extra RebA or UDP-glucose alone did not increase the conversion significantly, but the simultaneous addition of enzyme and UDP-glucose increased the conversion approximately 2-fold.

Experiments were conducted to examine the limit to this benefit of adding bolus amounts of UDP-glucose and fresh enzyme in the conversion of RebA to RebD reaction. Additional enzyme or enzyme and UDP-glucose were added after 1, 6, 24 and 28 hours. In the case of the addition of both extra EUGT11 and UDP-glucose, a conversion of more than 70% was achieved. No other components had a significant effect on the conversion. This indicates that EUGT11 is a primary limiting factor for the reaction but UDP-glucose also is limiting. As UDP-glucose is present at 3-fold higher concentration than RebA, this indicates that UDP-glucose may be somewhat unstable in the reaction mixture, at least in the presence of EUGT11. Alternatively, as explained below, EUGT11 may be metabolizing the UDP-glucose.

Inhibition Studies

Experiments were conducted to determine if factors such as sucrose, fructose, UDP, product (RebD) and impurities in the less pure *Stevia* extracts raw materials inhibited the extent of the conversion of steviol glycoside substrates to RebD. In a standard reaction mixture, excess of the potential inhibitors (sucrose, fructose, UDP, RebD, or a commercial blend of steviol glycosides (Steviva, Steviva Brands, Inc., Portland, Oreg.)) were added. Following incubation, RebD-production was quantified. Addition of 500 μg/ml of the commercial Steviva mix (approximately 60% 1,2-stevioside, 30% RebA, 5% Rubusoside, 2% 1,2-bioside, less than 1% of RebD, RebC and others, as evaluated by LC-MS) was not found to be inhibitory, but rather increased the overall RebD production (to around 60 μM from around 30 μM without any addition) well beyond the RebD originally added with the blend (around 5 μM). From the molecules tested, only UDP was shown to have an inhibitory effect on RebD-production at the concentration used (500 μM), as measured by LC-MS. The RebD that was produced was less than 7 μM. This inhibition can be alleviated in the in vivo or in vitro reactions for RebD production, by including an UDP recycling system to UDP-glucose, either by yeast or by an added SUS (sucrose synthase enzyme) in conjunction with sucrose. Moreover, when working with lower amounts of UDP-glucose (300 μM), the addition of alkaline phosphatase to remove UDP-G does not increase the amount of RebD produced in the in vitro glycosylations substantially, suggesting that the UDP produced may not be inhibitory at these concentrations.

RebA Vs Crude Steviol Glycoside Mix

In some experiments, a crude steviol glycoside mix was used as a source of RebA instead of purified RebA. As such a crude steviol glycoside mix contains a high percentage of stevioside along with RebA, UGT76G1 was included in the reactions. In vitro reactions were performed as described above using 0.5 g/l of the Steviva® mix as substrate and enzyme (UGT76G1 and/or EUGT11) and incubated at 30° C. The presence of steviol glycosides was analyzed by LC-MS.

When only UGT76G1 was added to the reactions, stevioside was converted to RebA quite efficiently. An unknown penta-glycoside (with a retention time peak at 4.02 min) also was detected. When only EUTG11 was added to the reaction, large amounts of RebE, RebA, RebD and an unknown steviol-pentaglycoside (with a retention time peak at 3.15 min) were found. When both EUGT11 and UGT76G1 were added to the reactions, the stevioside peak was reduced, and almost entirely converted to RebA and RebD. There were trace amounts of the unknown steviol-pentaglycoside (peak at 4.02 min). No RebE was detected nor was the second unknown steviol-pentaglycoside (peak at 3.15 min). This result indicated that the use of *stevia* extracts as a substrate to produce RebD in vitro is possible when EUGT11 and UGT76G1 are used in combination.

Non-Specific UDP-Glucose Metabolism

To determine if EUGT11 can metabolize UDP-glucose independently of the conversion of RebA to RebD, GST-purified EUGT11 was incubated in the presence or absence of RebA substrate, and UDP-glucose usage was measured as UDP-release, using the TR-FRET Transcreener® kit (BellBrook Labs). The Transcreener® kit is based on a tracer molecule bound to an antibody. The tracer molecule is displaced by UDP or ADP in a highly sensitive and quantitative manner. The FP kit includes an Alexa633 tracer bound to an antibody. The tracer is displaced by UDP/ADP. The displaced tracer freely rotates leading to a decrease in fluorescence polarization. Therefore, UDP production is proportional to a decrease in polarization. The FI kit includes a quenched Alexa594 Tracer bound to an antibody, which is conjugated to an IRDye® QC-1 quencher. The tracer is displaced by UDP/ADP, whereby the displaced tracer is un-quenched, leading to a positive increase in fluorescence intensity. Therefore, UDP production is proportional to an increase in fluorescence. A TR-FRET kit includes a HiLyte647 Tracer bound to an Antibody-Tb conjugate. Excitation of the terbium complex in the UV range (ca. 330 nm) results in energy transfer to the tracer and emission at a higher wavelength (665 nm) after a time delay. The tracer is displaced by UDP/ADP causing a decrease in TR-FRET.

It was observed that UDP-glucose measured was the same independent of the presence of RebA substrate. UDP release was not detectable in the absence of enzyme. This indicates a non-specific degradation of UDP-glucose by EUGT11. Nevertheless, RebD was still produced when RebA was added, suggesting that EUGT11 would preferentially catalyze RebA glycosylation over the non-specific UDP-glucose degradation.

Experiments were set up to find out the destiny of the glucose molecule in the absence of RebA or other obvious glycosylation substrates. One common factor in all previous reactions was the presence of Tris buffer and/or trace amounts of glutathione, which both contain potential glycosylation sites. The effect of these molecules on the non-specific UDP-glucose consumption was assayed using GST-purified EUGT11 (with glutathione) and HIS-purified enzyme (without glutathione) in in vitro reactions, in the presence or absence of RebA. UDP-glucose usage was measured as UDP-release, using the TR-FRET Transcreener® kit. UDP release occurred in all cases and was independent of the presence of RebA. UDP release was slower when the HIS-purified enzyme was used, but the overall catalytic activity of the enzyme in conversion of RebA to RebD was also lower, suggesting a lower amount of active soluble enzyme present in the assay. Therefore, it appears that the UDP-glucose metabolism by EUGT11 is independent of the presence of substrate and independent of the presence of glutathione in the reaction, under the conditions tested.

To test the effect of Tris on the metabolism of UDP-glucose by EUGT11, GST-EUGT11 was purified using a Tris- or a PBS-based buffer for the elution, obtaining similar amounts of protein in both cases. Tris- and PBS-purified enzymes were used in in vitro reactions using Tris and HEPES as buffers respectively, in the presence or absence of RebA in a similar manner as above. In both conditions, the UDP release was the same in the reactions whether RebA was added or not, indicating that the metabolism of UDP-glucose by EUGT11 is independent of both the presence of RebA and Tris in the reaction. This suggests that the UDP-release detected may somehow be an artifact caused by a property of EUGT11 or, alternatively, EUGT11 may be hydrolyzing UDP-glucose. EUGT11 is still efficient at converting RebA to RebD preferentially and the loss of UDP-G can be compensated by addition of the sucrose synthase recycling system described below.

RebA Solubility

The solubility of RebA determines the concentration that can be used both for the whole-cell approach and for the cell-free approach. Several different solutions of RebA in water were made and left at room temperature for several days. After 24 hours of storage, RebA precipitated at concentrations of 50 mM or higher. Twenty-five mM RebA started to precipitate after 4-5 days, while 10 mM or lower concentrations remained in solution, even when stored at 4° C.

RebD Solubility

The solubility of RebD was assessed by making several different solutions of RebD in water were made and incubated at 30° C. for 72 hours. RebD was found to be soluble in water initially in concentrations of 1 mM or lower while concentrations of 0.5 mM or less were found to be stable for longer periods of time. One with skill in the art will recognize that the solubility can be influenced by any number of conditions such as pH, temperature, or different matrices.

Sucrose Synthase

Sucrose synthase (SUS) has been used to regenerate UDP-glucose from UDP and sucrose (FIG. 11) for other small molecule glycosylations (Masada Sayaka et al. *FEBS Letters* 581 (2007) 2562-2566.). Three SUS1 genes from *A. thaliana, S. rebaudiana* and coffee (*Coffea arabica*) were cloned into pGEX4T1 *E. coli* expression vectors (see FIG. 17 for the sequences). Using methods similar to those described for EUGT11, around 0.8 mg/l of GST-AtSUS1 (*A. thaliana* SUS1) was purified. Initial expression of CaSUS1 (*Coffea arabica* SUS1) and SrSUS1 (*S. rebaudiana* SUS1) followed by GST-purification did not produce significant amounts of protein although, when analyzed by western blot, the presence of GST-SrSUS1 was verified. When GST-SrSUS1 was expressed at 20° C. in the presence of 2% ethanol, approximately 50 μg/l of enzyme was produced.

Experiments were performed to evaluate the UDP-glucose regenerating activity of the purified GST-AtSUS1 and GST-SrSUS1. In vitro assays were conducted in 100 mM Tris-HCl pH=7.5 and 1 mM UDP (final concentration). Either ~2.4 μg of purified GST-AtSUS1, ~0.15 μg of GST-SrSUS1, or ~1.5 μg commercial BSA (New England Biolabs, Ipswich, Mass.) were also added. Reactions were done in presence or absence of ~200 mM sucrose and incubated at 37° C. for 24 h. Product UDP-glucose was measured by HPLC as described in the analytical section. AtSUS1 produced ~0.8 mM UDP-glucose when sucrose was present. No UDP-glucose was observed when SrSUS1 or the negative control (BSA) was used. The lack of activity observed for SrSUS1 could be explained by the poor quality and concentration of the purified enzyme. UDP-glucose production by AtSUS1 was sucrose dependent and, therefore, it was concluded that AtSUS1 can be used in a coupled reaction to regenerate the UDP-glucose used by EUGT1 or other UGTs for small molecule glycosylation (FIG. 11, above).

SUS catalyzes the formation of UDP-glucose and fructose from sucrose and from UDP as depicted in FIG. 11. This UDP-glucose then can be used by EUGT11 for glycosylation of RebA to produce RebD. In vitro assays as described above were performed, adding ~200 mM sucrose, 1 mM UDP, 100 μM RebA, ~1.6 μg purified GST-AtSUS1 and ~0.8 μg GST-EUGT11. Formation of product, RebD, was evaluated by LC-MS. When AtSUS, EUGT11, sucrose and UDP were mixed with RebA, 81±5 μM of RebD was formed. The reaction was dependent on the presence of AtSUS, EUGT11 and sucrose. The conversion rate was similar to what has been observed previously using UDP-glucose provided extraneously. This shows that AtSUS can be used to regenerate UDP-glucose for RebD-formation by EUGT11.

Example 9

Whole-Cell Biocatalytic Production of RebD

In this example, several parameters were studied that are factors for using whole cell biocatalytic systems in the production of RebD from RebA or other steviol glycosides. The ability of raw materials to cross the cell membrane and availability of UDP-glucose are two such factors. Permeabilizing agents were studied as well as different cell types to ascertain which systems may be the most beneficial for RebD production.

Permeabilizing Agents

Several different permeabilization agents have previously been shown to allow intracellular enzymatic conversion of various compounds that are normally not able to cross a cell membrane (Chow and Palecek, *Biotechnol Prog.* 2004 March-April; 20(2):449-56). In several cases, the approaches resemble a partial lysis of the cells and, in yeast, often rely on the removal of the cell membrane by a detergent and the encapsulation of the enzymes inside of the remaining cell wall, which is permeable to smaller molecules. Common to these methods is the exposure to the permeabilizing agent followed by a centrifugation step to pellet cells before the addition of the substrate. See, for example, Flores et al., *Enzyme Microb. Technol.,* 16, pp. 340-346 (1994); Presecki & Vasic-Racki, *Biotechnology Letters,* 27, pp. 1835-1839 (2005); Yu et al., *J Ind Microbiol Biotechnol,* 34, 151-156 (2007); Chow and Palecek, *Cells. Biotechol. Prog.,* 20, pp. 449-456 (2004); Fernandez et al., *Journal of Bacteriology,* 152, pp. 1255-1264 (1982); Kondo et al., *Enzyme and microbial technology,* 27, pp. 806-811 (2000); Abraham and Bhat, *J Ind Microbiol Biotechnol,* 35, pp. 799-804 (2008); Liu et al.: *Journal of bioscience and bioengineering,* 89, pp. 554-558 (2000); and Gietz and Schiestl, *Nature Protocols,* 2, pp. 31-34 (2007) regarding permeabilization of yeast. See, Naglak and Wang, *Biotechnology and Bioengineering,* 39, pp. 732-740 (1991); Alakomi et al., *Applied and environmental Microbiology,* 66, pp. 2001-2005 (2000); and Fowler and Zabin, *Journal of bacteriology,* 92, pp. 353-357 (1966) regarding permeabilization of bacteria. As described in this example, it was determined if cells could remain viable and therefore could retain de novo UDP-glucose biosynthesis.

Experiments were done to establish conditions for permeabilization in *E. coli* and in yeast. Growing cells (*S. cerevisiae* or *E. coli*) were treated with different concentrations/combinations of permeabilization agents: toluene, chloroform and ethanol for permeabilization of *S. cerevisiae*, and guanidine, lactic acid, DMSO and/or Triton X-100 for permeabilization of *E. coli*. Tolerance of both model organisms to high concentrations of RebA and other potential substrates also was evaluated. The permeabilization was measured by the amount of RebD produced from a EUGT11-expressing organism after incubation in a RebA containing medium (feeding experiment). Enzyme activity was monitored before and after exposure to the permeabilizing agents by lysing the cells and analyzing the activity of the released UGTs in an in vitro assay.

In yeast, none of the permeabilization conditions tested resulted in an increase on RebD above the detected background (i.e., contaminating RebD levels present in the RebA stock used for feeding). This indicates that, under the tested conditions, yeast cells remain impermeable to RebA and/or the reduced cell viability caused by the solvents results in a decrease of EUGT11 activity as well.

In *E. coli*, none of the conditions tested resulted in permeabilization of the cells and subsequent production of RebD above background levels. Detectable levels of RebD were measured when lysates from strains expressing EUGT11 were used in the in vitro reactions (data not shown), indicating that EUGT11 enzyme is present and active even after all permeabilization treatments (though the level of activity varies). The permeabilization treatments had little or no effect on cell viability, except treating cultures with 0.2M guanidine and 0.5% TritonX-100, which severely decreased viability.

*S. cerevisiae* also was subjected to permeabilization assays not allowing further growth of the cells using Triton X-100, N-lauryl sarcosine (LS), or Lithium acetate+polyethylene glycol (LiAc+PEG). That is, under these conditions, permeabilization renders the cells unviable by removing the cell membrane altogether while retaining the cell-wall as a barrier to keep enzymes and gDNA inside. In such methods, UDP-glucose can be supplemental or recycled as described above. The advantage of permeabilization versus the purely in vitro approach is that individual enzymes do not need to be separately produced and isolated.

Figure 18:
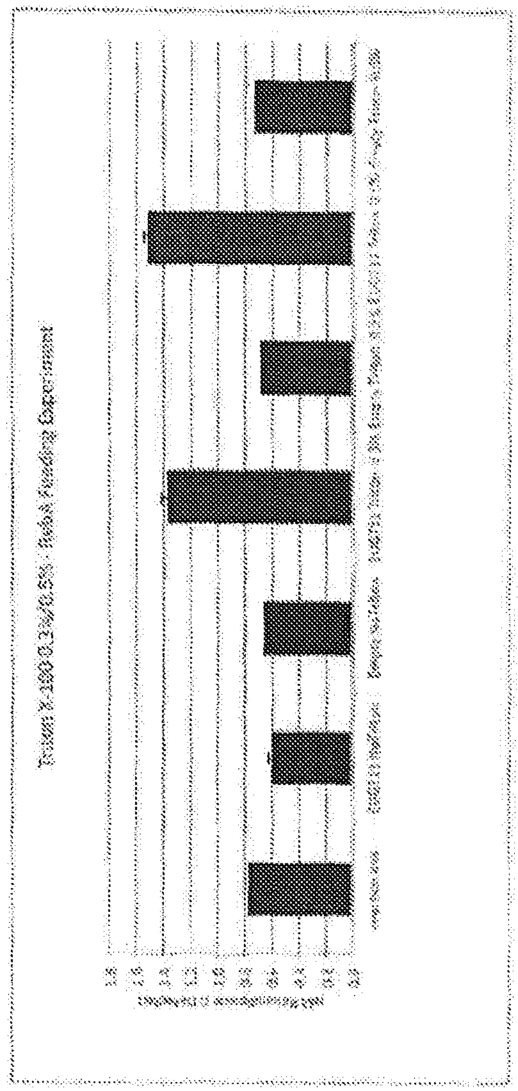
FIG. 18 is a bar graph of rebD production in permeabilized *S. cerevisiae*, which had been transformed with EUGT11 or an empty plasmid ("Empty"). Cells were grown to exponential growth phase, washed in PBS buffer and subsequently treated with Triton X-100 (0.3% or 0.5% in PBS) 30° C., 30 min. After permeabilization cells were washed in PBS and resuspended in reaction mix containing 100 μM RebA and 300 μM UDP-glucose. Reactions proceeded for 20 h, 30° C.

N-Lauryl sarcosine treatment resulted in inactivation of EUGT11 and only a minor increase in RebD was detected when LiAc/PEG was applied (data not shown). Treatment with Triton X-100 0.3% or 0.5%, however, increased the amount of RebD above background levels (see FIG. 18) while sustaining the activity of EUGT11. For Triton X-100 assays, overnight cultures were washed three times in PBS buffer. Cells corresponding to 6 $OD_{600}$ units were resuspended in PBS containing 0.3% or 0.5% Triton X-100 respectively. Treated cells were vortexed and incubated 30 minutes at 30° C. After treatment, cells were washed in PBS buffer. Cells corresponding to 5 $OD_{600}$ units were used in an in vitro assay, as described for GST-EUGT11 and 0.6 $OD_{600}$ units were resuspended in reaction buffer and incubated overnight at 30° C. as described for the LS treated samples. Untreated samples were used as controls.

Lysates from transformants expressing EUGT11 were able to convert some RebA into RebD (8 to 50 μM were measured in the reactions) when cells were untreated or after treatment with LiAC/PEG or Triton X100. However, no RebD was measured in lysates of cell pellets treated with LS. Permeabilized but non-lysed cells were able to produce some RebD (1.4 to 1.5 μM measured) when treated with 0.3% or 0.5% Triton X100 (FIG. 18) while no RebD was found on the samples treated with LS or LiAC/PEG. These results show that RebD can be produced from RebA biocatalytically using whole cells and using Triton X100 as the permeabilizing agent.

Example 10

Assessment of Codon Optimized UGT Sequences

Optimal coding sequences for UGT 91d2e, 74G1, 76G1, and 85C2 were designed and synthesized for yeast expression using two methodologies, supplied by GeneArt (Regensburg, Germany) (SEQ ID NOs: 6, 2, 8, and 4, respectively) or DNA 2.0 (Menlo Park, Calif.) (SEQ ID NOs: 84, 83, 85, and 82, respectively). The amino acid sequences of UGT 91d2e, 74G1, 76G1, and 85C2 (SEQ ID NOs: 5, 1, 7, and 3, respectively) were not changed.

The wild-type, DNA 2.0, and GeneArt sequences were assayed for in vitro activity to compare reactivity on substrates in the steviol glycosides pathway. UGTs were inserted in high copy (2μ) vectors and expressed from a strong constitutive promoter (GPD1) (vectors P423-GPD, P424-GPD, P425-GPD, and P426-GPD). The plasmids were transformed individually into the universal Watchmaker strain, EFSC301 (described in Example 3 of WO2011/153378) and assays were carried out using cell lysates prepared from equal amount of cells (80D units). For the enzymatic reactions, 6 μL t of each cell lysate were incubated in a 30 μL reaction with 0.25 mM steviol (final concentration) to test UGT74G1 and UGT85C2 clones, and with 0.25 mM 13-SMG (13SMG) (final concentration) to test 76G1 and 91D2e UGTs. Assays were carried out for 24 hours at 30° C. Prior to LC-MS analysis, one volume of 100% DMSO was added to each reaction, samples were centrifuged at 16000 g, and the supernatants analysed.

The lysates expressing the GeneArt-optimized genes provided higher levels of UGT activity under the conditions tested. Expressed as a percentage of the wild-type enzyme, the GeneArt lysates showed equivalent activity to the wild-type for UGT74G1, 170% activity for UGT76G1, 340% activity for UGT85C2 and 130% activity for UGT91D2e. Using UGT85C2 may improve the overall flux and productivity of cells for production of Reb-A and Reb-D when expressed in *S. cerevisiae.*

Further experiments were conducted to determine if the codon-optimized UGT85C2 could reduce 19-SMG accumulation and increase rubusoside and higher glycosylated steviol glycosides production. The production of 19-SMG and rubusoside were analysed in a steviol-feeding experiment of *S. cerevisiae* strain BY4741 expressing the wild type UGT74G1 as well as the codon-optimized UGT85C2 from high copy (20 vectors under strong constitutive promoter (GPD1) (vectors P426-GPD and P423-GPD, respectively). Whole culture samples (without cell removal) were taken and boiled in an equal volume of DMSO for total glycosides levels. Intracellular concentrations reported were obtained by pelleting cells, and resuspending in 50% DMSO to the volume of the original culture sample taken, followed by boiling. The "total" glycosides level and the normalized intracellular level then were measured using LC-MS. Using wild type UGT74G1 and wild type UGT85C2, approximately 13.5 μM rubusoside was produced in total with a maximum normalized intracellular concentration of about 7 μM. In contrast, when wild type UGT74G1 and codon-optimized UGT85C2 were used, a maximum of 26 μM rubusoside was produced, or approximately double of what was produced using the wild type UGT85C2. Additionally, the maximum normalized intracellular concentration of rubusoside was 13 μM, again an approximate doubling of what was produced using wild type UGT85C2. Intracellular concentration of 19-SMG was significantly reduced from a maximum of 35 μM using the wild type UGT85C2 to 19 μM using the codon-optimized UGT85C2. Consequently, about 10 μM less total 19-SMG was measured for the codon-optimized UGT85C2. This shows that more 19-SMG is converted into rubusoside and confirms that the wild type UGT85C2 is a bottleneck.

During diversity screening, another homolog of UGT85C2 was discovered during *Stevia rebaudiana* cDNA cloning. The homolog has the following combination of conserved amino acid polymorphisms (with respect to the amino acid numbering of the wild-type *S. rebaudiana* UGT85C coding sequence set forth in Accession No. AY345978.1): A65S, E71Q, T270M, Q289H, and A389V. This clone, termed UGT85C2 D37, was expressed through coupled in vitro transcription-translation of PCR products (TNT®T7 Quick for PCR DNA kit, Promega). The expression product was assayed for glycosylation activity using steviol (0.5 mM) as the sugar acceptor, as described in WO/2011/153378 with the exception that assays were allowed to incubate for 24 hours. As compared to the wildtype UGT85C2 control assay, the D37 enzyme appears to have approximately 30% higher glycosylation activity.

Example 11

Identification of a Novel *S. Rebaudiana* KAH

A partial sequence (GenBank Accession No. BG521726) was identified in the *Stevia rebaudiana* EST data base that had some homology to a *Stevia* KAH. The partial sequence was blasted against raw *Stevia rebaudiana* pyrosequencing reads using CLC main workbench software. Reads that partially overlapped with the ends of the partial sequence were identified and used to increase the length of the partial sequence. This was done several times until the sequence encompassed both the start- and the stop codons. The complete sequence was analyzed for frameshift mutations and nucleotide substitutions that may have been introduced by blasting the complete sequence against the raw pyrosequencing reads. The resulting sequence was designated SrKAHe1. See FIG. 12.

Activity of the KAH encoded by SrKAHe1 was assessed in vivo in *S. cerevisiae* background strain CEN.PK 111-61A, which expresses genes encoding enzymes constituting the entire biosynthetic pathway from the yeast secondary metabolites isopentenyl pyrophosphate (IPP) and farnesyl pyrophosphate (FPP) to steviol-19-O-monoside, except the steviol synthase enzyme that converts ent-kaurenoic acid to steviol.

Briefly, the *S. cerevisiae* strain CEN.PK 111-61A was modified to express an *Aspergillus nidulans* GGPPS, a 150 nt truncated *Zea mays* CDPS (with a new start codon, see below), a *S. rebaudiana* KS, a *S. rebaudiana* KO and the *S. rebaudiana* UGT74G1 from chromosomally integrated gene copies, with TPI1 and GPD1 yeast promoters driving transcription. The CEN.PK 111-61A yeast strain that expresses all of these genes was designated EFSC2386. Thus, strain EFSC2386 contained the following integrated genes: *Aspergillus nidulans* Geranyl geranyl pyrophosphate synthase (GGPPS); *Zea mays* ent-Copalyl diphosphate synthase (CDPS); *Stevia rebaudiana* ent-Kaurene synthase (KS); *Stevia rebaudiana* ent-kaurene oxidase (KO); and *Stevia rebaudiana* UGT74G1; in combination with the pathway from IPP and FPP to steviol-19-O-monoside, without a steviol synthase (KAH).

Expression of different steviol synthases (from episomal expression plasmids) was tested in strain EFSC2386 in combination with the expression of various CPRs (from episomal expression plasmids), and production of steviol-19-O-monoside was detected by LC-MS analysis of culture sample extracts. The nucleic acids encoding the CPRs were inserted in the multi cloning site of the p426 GPD basic plasmid while the nucleic acids encoding the steviol synthases were inserted in the multi cloning site the p415 TEF basic plasmid (p4XX basic plasmid series by Mumberg et al., *Gene* 156 (1995), 119-122). Production of steviol-19-O-monoside occurs when a functional steviol synthase enzyme is present.

The KAHs that were expressed from episomal expression plasmids in strain EFSC2386 were "indKAH" (Kumar et al, Accession no. DQ398871; Reeja et al., Accession No. EU722415); "KAH1" (*S. rebaudiana* steviol synthase from Brandle et al., U.S. Patent Publication No. 2008/0064063 A1); "KAH3" (*A. thaliana* steviol synthase from Yamaguchi et al., U.S. Patent Publication No. 2008/0271205 A1); "SrKAHe1" (*S. rebaudiana* steviol synthase cloned from *S. rebaudiana* cDNA as described above); and "DNA2.0.5rKAHel" (codon optimized sequence (DNA2.0) encoding *S. rebaudiana* steviol synthase, see FIG. 12B).

The CPRs that were expressed from episomal expression plasmids in strain EFSC2386 were "CPR1" (*S. rebaudiana* NADPH dependent cytochrome P450 reductase (Kumar et al., Accession no. DQ269454); "ATR1" (*A. thaliana* CPR, Accession No. CAA23011, see also FIG. 13); "ATR2" (*A. thaliana* CPR, Accession No. CAA46815, see also FIG. 13); "CPR7" (*S. rebaudiana* CPR, see FIG. 13, CPR7 is similar to "CPR1"); "CPR8" (*S. rebaudiana* CPR, similar to *Artemisia annua* CPR, see FIG. 13); and "CPR4" (*S. cerevisiae* NCP1 (Accession No. YHR042W, see also FIG. 13).

Table 13 provides the levels of steviol-19-O-monoside (μM) in strain EFSC2386 with the various combination of steviol synthases and CPRs.

TABLE 13

19-SMG Production

| Strain | 19-SMG production (μM) |
|---|---|
| "indKAH" CPR1 | 0.000 |
| "indKAH" ATR1 | 0.000 |
| "indKAH" ATR2 | 0.000 |
| "indKAH" CPR7 | 0.000 |
| "indKAH" CPR8 | 0.000 |
| "indKAH" CPR4 | 0.000 |
| "KAH1" CPR1 | 0.000 |
| "KAH1" ATR1 | 0.000 |
| "KAH1" ATR2 | 0.000 |
| "KAH1" CPR7 | 0.000 |
| "KAH1" CPR8 | 0.000 |
| "KAH1" CPR4 | 0.000 |
| "KAH3" CPR1 | 5.300 |
| "KAH3" ATR1 | 5.921 |
| "KAH3" ATR2 | 0.000 |
| "KAH3" CPR7 | 5.693 |
| "KAH3" CPR8 | 0.000 |
| "KAH3" CPR4 | 0.000 |
| "SrKAHe1" CPR1 | 20.129 |
| "SrKAHe1" ATR1 | 15.613 |
| "SrKAHe1" ATR2 | 40.407 |
| "SrKAHe1" CPR7 | 33.724 |
| "SrKAHe1" CPR8 | 41.695 |
| "SrKAHe1" CPR4 | 28.949 |
| "DNA2.0.SrKAHe1" CPR1 | 26.065 |
| "DNA2.0.SrKAHe1" ATR1 | 26.974 |
| "DNA2.0.SrKAHe1" ATR2 | 54.354 |
| "DNA2.0.SrKAHe1" CPR7 | 30.797 |
| "DNA2.0.SrKAHe1" CPR8 | 50.956 |
| "DNA2.0.SrKAHe1" CPR4 | 30.368 |

Only KAH3 and the steviol synthase encoded by SrKAHe1 had activity when expressed in *S. cerevisiae*. The DNA 2.0. codon optimized SrKAHe1 sequence encoding steviol synthase resulted in a level of steviol-19-O-monoside accumulation that was approximately one order of magnitude higher as compared with a codon optimized KAH3 when each were co-expressed with optimal CPRs. In the experiments presented in this example, the combination of KAH1 and ATR2CPR did not result in the production of steviol-19-O-monoside.

Example 12

Pairings of CPRs and KO

The CEN.PK *S. Cerevisiae* EFSC2386 strain and the CPRs referred to in this Example are described in the Example 11 ("Identification of *S. rebaudiana* KAH"). EFSC2386 contained the following integrated genes: *Aspergillus nidulans* Geranyl geranyl pyrophosphate synthase (GGPPS); *Zea mays* ent-copalyl diphosphate synthase (CDPS); *Stevia rebaudiana* ent-kaurene synthase (KS); and *Stevia rebaudiana* ent-kaurene oxidase (KO). This strain produces ent-kaurenoic acid that was detected by LC-MS analysis.

A collection of cytochrome P450 reductases (CPRs) were expressed and tested in strain EFSC2386; "CPR1" (*S. rebaudiana* NADPH dependent cytochrome P450 reductase, Kumar et al., Accession no. DQ269454); "ATR1" (*A. thaliana* CPR, Accession No. CAA23011); "ATR2" (*A. thaliana* CPR, Accession No. CAA46815); "CPR7" (*S. rebaudiana* CPR, CPR7 is similar to "CPR1"); "CPR8" (*S. rebaudiana* CPR, similar to *Artemisia annua* CPR; and "CPR4" (*S. cerevisiae* NCP1, Accession No. YHR042W).

Overexpression of the *S. cerevisiae* endogenous native CPR (referred to as CPR4 in Table 14), and especially overexpression of one of the *A. thaliana* CPRs namely ATR2, gives good activation of the *Stevia rebaudiana* kaurene oxidase (the latter called KO1 in Table 14) and results in increased accumulation of ent-kaurenoic acid. See Table 14, which presents the area under curve (AUC) of the ent-kaurenoic acid peak in the LC-MS chromatograms. KO1 is an ent-kaurenoic acid producing yeast control strain without additional overexpression of CPRs.

TABLE 14

Effect of Different Cytochrome P450 Reductase Enzymes with KO-1

| Cytochrome P450 Reductase | Ent-Kaurenoic Acid (AUC) |
|---|---|
| CPR-1 | 14113 |
| ATR-1 | 13558 |
| ATR-2 | 29412 |
| CPR-7 | 18918 |
| CPR-8 | 12590 |
| CPR-4 | 25103 |
| Control | 16593 |

Example 13

Evaluating KS-5 and KS-1 in Steviol Pathways

The yeast strain EFSC1972 is a CEN.PK 111-61A *S. cerevisiae* strain that has the biosynthetic pathway from IPP/FPP to rubusoside expressed by integrated gene copies encoding the *Aspergillus nidulans* GGPPS (internal name GGPPS-10), the *Stevia rebaudiana* KS (KS1, SEQ ID NO:133), the *Arabidopsis thaliana* KAH (KAH-3, SEQ ID NO:144), the *Stevia rebaudiana* KO (KO1, SEQ ID NO:138), the *Stevia rebaudiana* CPR(CPR-1, SEQ ID NO:147), the full length *Zea mays* CDPS (CDPS-5, SEQ ID NO:158), the *Stevia rebaudiana* UGT74G1 (SEQ ID NO:1) and *Stevia rebaudiana* UGT85C2 (SEQ ID NO:3). Furthermore EFSC1972 has down regulation of the ERG9 gene expression by displacement of the endogenous promoter with the cupper inducible promoter CUP1.

When EFSC1972 is transformed with a CEN/ARS-based plasmid that expresses the *Stevia rebaudiana* SrKAHe1 from a TEFL promoter, and simultaneously transformed with 2μ-based plasmids that express the *Synechococcus* sp GGPPS (GGPPS-7) and a truncated version of the *Zea mays* CDPS (truncated CDPS-5) from a GPD promoter, the result is growth-impaired *S. cerevisiae* producer of rubusoside (and 19-SMG). This strain is referred to as the "enhanced EFSC1972" in the following text. To determine whether the slow growth rate is caused by accumulation of the toxic pathway intermediate ent-copalyl diphosphate, a collection of kaurene synthase (KS) genes was expressed in the "enhanced EFSC1972" strain then growth and steviol glycoside production was assessed.

Figure 16:
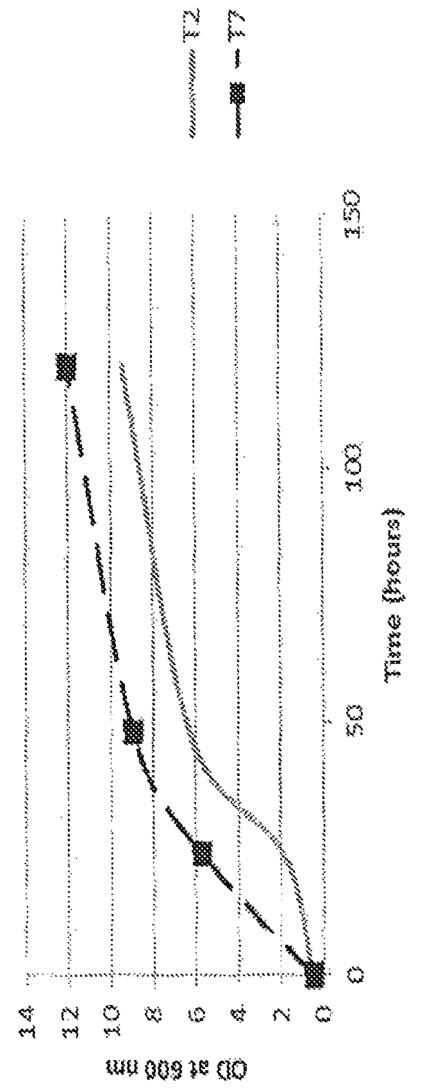
FIG. 16 is a graph of the growth of two strains of *S. cerevisiae*, enhanced EFSC1972 (designated T2) and enhanced EFSC1972 with further overexpression of the *Arabidopsis thaliana* kaurene synthase (KS-5) (designated T7, squares). Numbers on the y-axis are OD600 values of the cell culture, while numbers on the x-axis represent hours of growth in synthetic complete based medium at 30° C.

Expression of the *A. thaliana* KS (KS5) results in improved growth and steviol glycoside production of the "enhanced EFSC1972" strain. See FIG. 16. The same positive effect on growth cannot be achieved by further overexpression of the *Stevia rebaudiana* kaurene synthase (KS-1) in the enhanced EFSC1972 (data not shown).

Example 14

Yeast Strain EFSC1859

*Saccharomyces cerevisiae* strain EFSC1859 contains GGPPS-10, CDPS-5, KS-1, KO-1, KAH-3, CPR-1 and UGT74G1 coding sequences integrated into the genome and expressed from the strong constitutive GPD1 and TPI promoters. See Table 15. In addition, the endogenous promoter for the yeast ERG9 gene was replaced with the copper inducible promoter CUP1 for downregulation of the ERG9 squalene synthase. In standard yeast growth medium, the ERG9 gene is transcribed at very low levels, since the concentration of copper in such medium is low. The decrease in ergosterol production in this strain results in increased amounts of isoprene units available for isoprenoid biosynthesis. In addition, strain EFSC1859 also expresses UGT85C2 from a 2 micron multicopy vector using a GPD1 promoter. EFSC1859 produces rubusoside and steviol 19-O-glycoside.

*Zea mays* CDPS DNA, with and without the chloroplast signal peptide, was expressed from a 2 micron multicopy plasmid using the GPD promoter. The nucleotide sequence and amino acid sequence of the *Zea mays* CDPS are forth in FIG. 14. The chloroplast signal peptide is encoded by nucleotides 1-150 and corresponds to residues 1 to 50 of the amino acid sequence.

TABLE 15

| Gene Source | Enzyme | Designation | gi Number | Accession No. |
|---|---|---|---|---|
| *Aspergillus nidulans* | GGPP synthase | GGPPS-10 (C301) | 29468175 | AF479566 |
| *Zea mays* | CDP synthase | CDPS-5 (EV65) | 50082774 | AY562490 |
| *Stevia rebaudiana* | Kaurene synthase | KS-1 | 4959241 | AAD34295 |
| *Stevia rebaudiana* | KO | KO-1 | 76446107 | ABA42921 |
| *Arabidopsis thaliana* | KAH | KAH-3 | 15238644 | NP_197872 |
| *Stevia rebaudiana* | UGT74G1 | | | |
| *Stevia rebaudiana* | UGT85C2 | | | |
| *Stevia rebaudiana* | CPR | CPR-1 | 93211213 | ABB88839 |

EFSC1859+maize full-length CDPS plasmid, and EFSC+ maize truncated CDPS plasmid were grown in selective yeast medium with 4% glucose. Rubusoside and 19-SMG production were measured by LC-MS to estimate the production level. The removal of the plastid leader sequence did not appear to increase steviol glycoside production as compared to the wild-type sequence, and demonstrates that the CDPS transit peptide can be removed without causing a loss of steviol glycoside biosynthesis.

Example 15

Yeast Strain EFSC1923

*Saccharomyces cerevisiae* strain CEN.PK 111-61A was modified to produce steviol glycosides by introduction of steviol glycoside pathway enzymes from various organisms. The modified strain was designated EFSC1923.

Strain EFSC1923 contains an *Aspergillus nidulans* GGPP synthase gene expression cassette in the *S. cerevisiae* PRP5—YBR238c intergenic region, a *Zea mays* full-length CDPS and *Stevia rebaudiana* CPR gene expression cassette in the MPT5-YGL176C intergenic region, a *Stevia rebaudiana* kaurene synthase and CDPS-1 gene expression cassette in the ECM3-YOR093C intergenic region, an *Arabidopsis thaliana* KAH and *Stevia rebaudiana* KO gene expression cassette in the KIN1-INO2 intergenic region, a *Stevia rebaudiana* UGT74G1 gene expression cassette in the MGA1-YGR250C intergenic region and a *Stevia rebaudiana* UGT85C2 gene expression cassette integrated by displacing the TRP1 gene ORF. See Table 15. In addition, the endogenous promoter for the yeast ERG9 gene was replaced with the copper inducible promoter CUP1.

Strain EFSC1923 produced approximately 5 µM of the steviol glycoside, steviol 19-O-monoside, on selective yeast medium with 4% glucose.

Example 16

Expression of a Truncated Maize CDPS in Yeast Strain EFSC1923

The 150 nucleotides at the 5' end of the *Zea mays* CDP synthase coding sequence in Table 15 (SEQ ID NO:157, see FIG. 14) was deleted, the remainder of the coding sequence was provided with a new translation start ATG, and the truncated sequence was operably linked to the GPD1 promoter in the multicopy plasmid p423GPD in *Saccharomyces cerevisiae* EFSC1923. Plasmid p423GPD is described in Mumberg, D et al, *Gene,* 156: 119-122 (1995). EFSC1923 and EFSC1923 plus p423GPD-Z.m.tCDPS were grown in for 96 hours in selective yeast medium containing 4% glucose. The amount of steviol 19-O-monoside produced by EFSC1923+p423GPD-Z.m.tCDPS (the truncated *Zea mays* CDPS) under these conditions was approximately 2.5 fold more than that produced by EFSC1923 without the plasmid.

The *Arabidopsis thaliana* KAH coding sequence from Table 15 was inserted in a multicopy plasmid designated p426GPD, under the control of the GPD1 promoter. Plasmid p426GPD is described in Mumberg, D et al, *Gene,* 156: 119-122 (1995). No significant difference was observed between the amount of steviol 19-O-monoside produced by EFSC1923+p426GPD-A.t.KAH, and EFSC1923 lacking the plasmid.

EFSC1923 was transformed with both p423GPD-Z.m.tCDPS and p426 p426GPD-A.t.KAH. Surprisingly, the amount of steviol 19-O-monoside produced under these conditions by EFSC1923 harboring both plasmids (i.e., the truncated *Zea mays* CDPS and *Arabidopsis* KAH) was more than 6 fold greater than the amount produced by EFSC1923 alone.

A bifunctional CDPS-KS from *Gibberella fujikuroi* (NCBI Accession no: Q9UVY5.1, FIG. 15) was cloned and compared to the truncated CDPS-5. The bifunctional *Gibberella* CDPS-KS was cloned into a 2µ plasmid with a GPD promoter and transformed with a plasmid expressing the *Arabidopsis thaliana* KAH-3 from a 2µ based-plasmid from a GPD promoter into EFSC1923. In shake flask studies, this bifunctional CDPS-KS was about 5.8 times more active in producing steviol 19-O-monoside than strain EFSC1923 with the KAH-3 alone. However, it was found to be less optimal than the KAH-3 and truncated CDPS combination under the conditions tested. Therefore, further strains were constructed with KS-5 and truncated CDPS.

Example 17

Toxicity of Intermediates

The effect on *S. cerevisiae* vitality of geranyl geranyl pyrophosphate (GGPP), ent-copalyl diphosphate (CDP) or ent-kaurene production was investigated by expression of *Synechococcus* sp GGPPS alone (GGPP production), the GGPPS and the 50 amino acid N-terminally truncated *Zea mays* CDPS (see Example 16) together (CDP production), or the GGPPS, truncated CDPS and the *Arabidopsis thaliana* kaurene synthase (KS5) together (ent kaurene production) in the laboratory *S. cerevisiae* strain CEN.PK background. Genes were expressed from 2μ plasmids with GPD promoters driving transcription of truncated CDPS and KS5, while transcription of the GGPPS was driven by the ADH1 promoter. The growth of *S. cerevisiae* CEN.PK transformed with various combinations of these plasmids (GGPPS alone; GGPPS+truncated CDPS; or GGPPS+truncated CDPS+KS5) or plasmids without gene insertions was observed. GGPP production, and especially CDP production, was toxic to *S. cerevisiae* when produced as end products. Interestingly, ent-kaurene appeared to not be toxic to yeast in the amounts produced in this experiment.

Example 18

Disruption of Endogenous Phosphatase Activity

The yeast genes DPP1 and LPP1 encode phosphatases that can degrade FPP and GGPP to farnesol and geranylgeraniol, respectively. The gene-encoding DPP1 was deleted in strain EFSC1923 (described in Example 15) to determine if there was an effect on steviol glycoside production. When this dpp1 mutant strain was further transformed with a plasmid expressing the *Z. mays* CDPS lacking the chloroplast transit sequence (Example 16), both small and large transformants emerged. Strains of the "large colony" type produced ~40% more 19-SMG as compared to "small colony" type and the non-DPP1 deleted strain, under the conditions tested. These results indicate that deletion of DPP1 can have a positive effect on steviol glycoside production and that the degradation of prenyl pyrophosphates in yeast therefore could influence steviol glycoside production negatively.

Example 19

Construction of a Genetically Stable Yeast Reporter Strain Producing Vanillin Glucoside from Glucose with a Disrupted SUC2 Gene A yeast strain producing vanillin glucoside from glucose was created basically as described in Brochado et al. ((2010) *Microbial Cell Factories* 9:84-98) (strain VG4), but with additional integration into the ECM3 inter-locus region in the yeast genome of an expression cassette with *E. coli* EntD PPTase controlled by the yeast TPI1 promoter (as described in Hansen et al. (2009) *Appl. Environ. Microbiol.* 75(9): 2765-2774), disruption of SUC2 by replacing coding sequence with a MET15 expression cassette, and disruption of LEU2 by replacing coding sequence with a TnSble expression cassette conferring resistance to phleomycin. The resulting yeast strain was called V28. This strain also encodes a recombinant *A. thaliana* UDP-glycosyltransferase (UGT72E2, GenBank Accession No. Q9LVR1) having the amino acid sequence set forth in FIG. 19 (SEQ ID NO:178).

Example 20

Expression of Sucrose Transporter and Sucrose Synthase in Yeast Already Biosynthesizing Vanillin Glucoside A sucrose transporter SUC1 from *Arabidopsis thaliana* was isolated by PCR amplification from cDNA prepared from *A. thaliana*, using proof-reading PCR polymerase. The resulting PCR fragment was transferred by restriction digestion with SpeI and EcoRI and inserted into the corresponding in the low copy number yeast expression vector p416-TEF (a CEN-ARS based vector), from which the gene can be expressed from the strong TEF promoter. The resulting plasmid was named pVAN192. The sequence of the encoded sucrose transporter is set forth in FIG. 19B (GenBank Accession No. AEE35247, SEQ ID NO:179).

A sucrose synthase SUS1 from *Coffea arabica* (Accession No. CAJ32596) from was isolated by PCR amplification from cDNA prepared from *C. arabica*, using proof-reading PCR polymerase. The PCR fragment was transferred by restriction digestion with SpeI and SalI and inserted into the corresponding position in the high copy number yeast expression vector p425-GPD (a 2 μm based vector), from which the gene can be expressed from the strong GPD promoter. The resulting plasmid was named pMUS55. The sequence of the encoded sucrose synthase is set forth in FIG. 19C (GenBank Accession No. CAJ32596; SEQ ID NO:180).

pVAN192 and pMUS55 were introduced into the yeast strain V28 by genetic transformation, using a lithium acetate transformation protocol, creating the yeast strain V28::pVAN192::pMUS55. A control strain was made by transforming V28 with the empty plasmids P146-TEF and P425-GPD.

These two yeast strains were grown in 200 ml cultures in 500 ml Erlenmeyer shake flasks using SC (synthetic complete) growth medium without aromatic amino acids supplemented with 2% glucose and 2% sucrose and adjusted to pH 5.0. Cultures were incubated at moderate revolution (150 rpm), at 30° C. for 72 hours. Samples were taken at 72 hours, and the content of vanillin glucoside determined. As can be seen from the table below, VG production in the control strain (containing empty plasmids p416-TEF and p425-GPD) was 330 mg/L VG, while the yeast strain V28::pVAN192::pMUS55 expressing sucrose synthase and sucrose transporter produced 445 mg/l VG, corresponding to a 34.8% increase in VG production.

| Strain | Vanillin glucoside (g/L after 72 h) |
| --- | --- |
| V28 (p416-TEF + P425-GPD) | 330 |
| V28::pVAN192::pMUS55 | 445 |

This indicates that co-expression of a sucrose synthase and a sucrose transporter together with a glucosyltransferase increased the ability to glycosylate a small molecule aglycon, and concentration of the glycosylated aglycon was significantly increased. In this case, a significant improvement in vanillin glucosylation was achieved, resulting in a significant increase in titer of the end product, vanillin-O-β-glucoside.

Example 21

Improved Steviol Glycoside Producing Strains

Strain Construction of *Saccharomyces cerevisiae* EFSC2763

EFSC2763 yeast strain is derived from a wild type *Saccharomyces cerevisiae* strain containing three auxotrophic modifications, namely the deletions of URA3, LEU2 and HIS3. The genetics of the strain have been stabilized and can be used as a regular diploid or haploid yeast strain. EFSC2763 has been converted to a steviol glycoside producing yeast by genomic-integration of four DNA constructs. Each construct contains multiple genes that were introduced into the yeast genome by homologous recombination. Furthermore, construct one and two were assembled by homologous recombination.

The first construct contains eight genes and is inserted in the DPP1 locus and disrupts and partially deletes DPP1 (see Example 18). The DNA inserted contains: the *A. gossypii* TEF promoter expressing the NatMX gene (selectable marker) followed by the TEF terminator from *A. gossypii*; Gene Art codon optimized *S. rebaudiana* UGT85C2 (see Example 10) expressed from the native yeast GPD1 promoter and followed by the native yeast CYC1 terminator; *S. rebaudiana* CPR-8 (see FIG. 13) expressed using the TPI1 promoter followed by the native yeast TDH1 terminator; *A. thaliana* Kaurene synthase (KS-5, see Example 13, SEQ ID NO:156) expressed from the PDC1 promoter and followed by the native yeast FBA1 terminator; *Synechococcus* sp. GGPPS (GGPPS-7) expressed using the TEF2 promoter and followed by the native yeast PFI1 terminator; DNA2.0 codon-optimized *S. rebaudiana* KAHe1 (see Example 11, SEQ ID NO:165), expressed from the TEF1 promoter and followed by the ENO2 terminator; *S. rebaudiana* KO-1 expressed using the FBA1 promoter and followed by the native yeast TDH2 terminator; and *Zea mays* truncated CDPS (see Example 14) expressed using the PGK1 promoter and followed by the native yeast ADH2 terminator.

The second construct was inserted at the YPRCΔ15 locus and contains the native yeast TEF promoter from *A. gossypii* in front expressing the KanMX gene (selectable marker) followed by the TEF terminator from *A. gossypii*, the Gene Art codon optimized *A. thaliana* ATR2 (see FIG. 13B) expressed from the PGK1 promoter followed by the yeast ADH2 terminator, *S. rebaudiana* UGT74G1 expressed from the TPI1 promoter followed by the yeast TDH1 terminator, Gene Art codon-optimized *S. rebaudiana* UGT76G1 expressed from the TEF1 promoter followed by the yeast ENO2 terminator, and GeneArt codon-optimized *S. rebaudiana* UGT91D2e-b (see Example 6) expressed from the GPD1 promoter and followed by the yeast CYC1 terminator.

The first and the second construct were combined in the same spore clone by mating and dissection. This yeast strain was subsequently transformed with construct three and four in two successive events.

Construct three was integrated between genes PRP5 and YBR238C and contained the TEF promoter from *A. gossypii* in expressing the *K. lactis* LEU2 gene followed by the TEF terminator from *A. gossypii*, the GPD1 promoter expressing the DNA2.0-optimized *S. rebaudiana* KAHe1 followed by the CYC1 terminator, and the TPI1 promoter expressing the *Zea mays* truncated CDPS. Construct four was integrated in the genome between genes ECM3 and YOR093C with an expression cassette containing the TEF promoter from *A. gossypii* expressing the *K. pneumoniae* hph gene followed by the TEF terminator from *A. gossypii, Synechococcus* sp. GGPPS expressed from the GPD1 promoter followed by the CYC1 terminator, and the TPI1 promoter expressing the *A. thaliana* Kaurene synthase. The four utilized genetic markers were subsequently removed.

As analyzed by LC-MS following the DMSO-extraction of total steviol glycosides from cells and broth, EFSC2772 produces between 40-50 μM or 2-3 μM/OD600 Rebaudioside A, after growth for four days in 3 ml SC (Synthetic Complete) media at 30° C. with 320 RPM shaking in deep-well plates.

Strain Construction of *Saccharomyces cerevisiae* EFSC2772

EFSC2772 is very similar to strain 2763 with the exception that the genetic markers were not removed, and the strain was made prototrophic by introduction of the two plasmids p413TEF (public domain CEN/ARS shuttle plasmid with HIS3 marker) and p416-TEF (public domain CEN/ARS shuttle plasmid with URA3 marker) by transformation, and designated EFSC2772.

As analyzed by LC-MS following the DMSO-extraction of total steviol glycosides from cells and broth, EFSC2772 produces similar levels of Rebaudioside A as 2763, after growth in deep-well plates. Higher optical densities and higher titers were obtained through aerobic fed-batch growth in 2 L (working volume) fermentors which included a ~16 hour growth phase in the base medium (Synthetic Complete media) followed by ~100 hours of feeding with glucose utilized as the carbon and energy source combined with trace metals, vitamins, salts, and Yeast Nitrogen Base (YNB) and/or amino acid supplementation. The pH was kept near pH 5 and the temperature setpoint was 30° C. As evidenced by LC-MS, combined cellular and extracellular product concentrations were between 920-1660 mg/L of Reb-A and approximately 300-320 mg/L of Reb-D in the two different experiments, approximately 700 mg/L of Reb-A was detected in the broth when the higher titer results were obtained. Additionally a large peak was seen for Reb-B, and one skilled in the art will recognize that additional copies of UGT74G1 or upregulation of UGT74G1 will further increase the conversion of RebB to RebA.

Strain EFSC2743 was made in a similar manner as above, but without the two plasmids conferring prototrophy and with the addition of a p416 (CEN/ARS)-based plasmid expressing EUGT11 from the TEF promoter. This strain was grown in a fed-batch fermentation as above. This strain produced a total amount of RebD of 920 mg/L and furthermore approximately a 9:1 ratio of RebD to RebA was seen. Approximately 360 mg/L of RebD was found in the broth.

Example 22

UDP-Glucose Capacity

In Example 21, it was shown that yeast can fully glycosylate over 1 mM steviol e.g., to RebD, RebB, and RebA. Similarly, *Saccharomyces* strains are able to glycosylate as much as 60 mM of other small molecule products (data not shown). However, the glycosylation limit of the yeast native UDP-glucose regenerating system is unknown, or the rate at which it replenishes the UDP-glucose pool needed for cell wall synthesis. Therefore, experiments were designed to investigate if an increase in UDP-glucose production would increase the glycosylation rate in yeast. A suc2 deletion mutant was transformed with plasmids harboring the *A. thaliana* suc1 gene encoding a sucrose transporter, UGT74G1 and *A. thaliana* SUS. UGT74G1 can rapidly glycosylate steviol to steviol 19-O-monoglucoside (19-

SMG). Transformants were pre-grown overnight in 13-ml culture tubes containing 4 ml of SC medium lacking leucine, histidine and uracil. The next day, cells corresponding to 2 $OD_{600}$ units were spun down and resuspended in 2 ml of fresh media was containing 2% sucrose and or 100 μM steviol. Cultures were shaken at 30° C. for 3 days in culture tubes. After 1 h, 3 h, 6 h, 21 h and 46 h, aliquots were taken. Aliquots of 100 μA of culture were spun down and an equal volume of DMSO was added. Samples were vortexed, heated at 80° C. for 15 minutes, centrifuged, and the 19-SMG content analyzed by LC-MS. No difference in the rate of glycosylation of steviol was observed between wild-type and SUS1-augmented strains at the time points tested. This suggests that glycosylation of steviol by UGT74G1 proceeds at a slower rate than UDP-glucose is regenerated by the yeast and that extra UDP-glucose may not be needed to achieve high titers of small molecule glycosylation in vivo. Nevertheless, the use of a SUS to recycle UDP-glucose in vitro is shown in Example 8 and therefore its use in an in vivo system is expected to increase the rate of production of steviol glycosides, if UDP-glucose should become limiting.

Example 23

Reb-C and Reb-F Production In Vivo from Glucose

Production of RebC from Steviol

Previous experiments (Publication No. WO/2011/153378) have shown that recombinantly expressed *Arabidopsis thaliana* RHM2 (rhamnose synthetase, locus tag AT1G53500) is able to convert UDP-glucose to UDP-rhamnose. This UDP-rhamnose can be used to produce steviol-13-O-glucopyranosyl-1,2-rhamnoside, when incubated with UGT91D2e and steviol-13-O-monoglucoside in vitro.

Further experiments were conducted to confirm production of RebC from steviol by expressing all 4 UGTs and the RHM2 in yeast in vivo, followed by steviol feeding. EFSC301 strain (MAT alpha, lys2ADE8 his3ura3leu2trp1) was transformed with the following plasmids expressing wild type gene sequences: p424GPD expressing wild type UGT74G1 (Accession no: AY345982); p423GPD expressing wild type 85C2 (Accession no.: AY345978.1); and a p426GPD derived-plasmid expressing wildtype UGT76G1 (Accession no: AY345974) and UGT91D2e under GPD promoters. Plasmid p425GPD expressing either RHM2 or an empty p425GPD control plasmid was cotransformed with the UGTs. Transformants were pre-grown overnight in 13 mL culture tubes containing 2-3 ml of SC medium lacking leucine, histidine, tryptophan and uracil. The next day, after growth had reached 0.4 $OD_{600}$ units, cells were spun down, resuspended in fresh medium containing 25 μM steviol and shaken at 30° C. for 3 days in culture tubes. An aliquot of 100 μL of culture was spun down. An equal volume of DMSO was added to the supernatant of this sample while 200 μL of 50% DMSO was added to the pellet. Samples were vortexed, heated at 80° C. for 15 minutes, centrifuged, and the steviol glycoside content analyzed by LC-MS. RebC was detected in growth media and cellular extracts only when the RHM2 gene was coexpressed with the UGTs. Quantification showed that approximately equal amounts of RebA and RebC were produced. This shows that RHM2 is able to produce significant quantities of UDP-rhamnose in vivo and that UGT91D2e is capable of efficient rhamnosylation in vivo. Two other compounds were observed via LC-MS with retention times of 5.64 and 5.33 minutes and m/z ratios corresponding to steviol with 1 glucose- and 1 rhamnose (steviol-1,2 rhamnobioside), and 2 glucoses- and 1 rhamnose (Dulcoside A), respectively. This suggests that the remaining UGTs in the steviol glycoside pathway are capable of accepting rhamnosylated intermediates, i.e, the rhamnosylation step does not need to occur last.

In addition, a series of sequential in vitro experiments were conducted to determine whether any dead-end reactions occur in the rebaudioside C pathway. See FIG. 2B. For example, the rhamnosylation activity of UGT91D2e on rubusoside and subsequent conversion of the product to RebC by UGT76G1 was demonstrated using in vitro reactions. In this experiment, UGT91D2e and RHM2 recombinantly expressed in *E. coli* and purified were incubated overnight with rubusoside, NADPH, $NAD^+$ and UDP-glucose. The reaction mixture was subsequently boiled to denature the enzymes. An aliquot of the reaction was added to an enzyme preparation of UGT76G1 with UDP-glucose. The rubusoside was converted in the presence of UGT91D2e and RHM2 to a compound with m/z corresponding to steviol with 2-glucoses and 1-rhamnose. Subsequently, this compound was converted in the presence of UGT76G1 to RebC, which indicates that the intermediate is Dulcoside A. This experiment therefore demonstrates that UGT91D2e is able to rhamnosylate rubusoside and that UGT76G1 is able to convert the product to RebC.

Similarly, it was shown through in vitro reactions that rhamnosylation of 13-SMG by UGT91D2e (forming a steviol compound with one glucose and one rhamnose) and subsequent formation of a compound with 2 glucoses and 1 rhamnose by UGT76G1. This compound has a unique retention time (4.56 min) and is thought to be steviol 13-O-1,3-diglycoside-1,2-rhamnoside. This compound also was observed when steviol was fed to yeast expressing the four UGTs and RHM2.

From the current data, it is shown that UGT91D2e is able to rhamnosylate 13-SMG and rubusoside. It is also shown that UGT74G1 and UGT76G1 are able to metabolize the rhamnosylated compound produced by UGT91D2e from 13-SMG. When these compounds are incubated with the remaining UGT (UGT74G1 or UGT76G1 depending on which UGT was used for the previous step), RebC is formed. This indicates that the order of glycosylation is of little importance as UGT74G1 and UGT76G1 are able to glycosylate rhamnosylated substrates.

Production of RebC from Glucose

Plasmids expressing RHM2 and UGTs 76G1 and 91D2e were transformed into a stable rubusoside producer, the EFSC1923 strain (see Example 15). This yeast is a *Saccharomyces cerevisiae* CEN.PK 111-61A derivative with the UGTs 85C2 (Accession no.: AY345978.1) and 74G1 (Accession no: AY345982) integrated into the genome as well as auxotrophic modifications. In strain EFSC1923 (see Example 15), expression of squalene synthase, which is encoded by ERG9, was downregulated by displacement of the endogenous promoter with the CUP1 copper-inducible promoter. Strain EFSC1923 also contains an *Aspergillus nidulans* GGPP synthase (GGPPS-10) expression cassette in the *S. cerevisiae* PRP5-YBR238c intergenic region, a *Zea mays* full-length CDPS (CDPS-5) and *Stevia rebaudiana* CPR(CPR-1) gene expression cassette in the MPT5-YGL176C intergenic region, a *Stevia rebaudiana* Kaurene synthase and CDPS (KS-1/CDPS-1) gene expression cassette in the ECM3-YOR093C intergenic region, an *Arabidopsis thaliana* KAH (KAH-3) and *Stevia rebaudiana* KO (KO-1) gene expression cassette in the KIN1-INO2 intergenic region, a *Stevia rebaudiana* UGT74G1 gene expression cassette in the MGA1-YGR250C intergenic region and a *Stevia rebaudiana* UGT85C2 gene expression cassette integrated by displacing the TRP1 gene ORF20. Inserted steviol pathway genes are described in Table 11 of published PCT WO/2011/153378.

EFSC1923 strain was transformed with a p423GPD-derived plasmid expressing wildtype UGT74G1 and UGT85C2 sequences using GPD promoters and a p426GPD-derived plasmid expressing wildtype UGT76G1 (Accession no: AY345974) and UGT91D2e (see SEQ ID NO:5) under the control of GPD promoters. Plasmid p425GPD expressing *Arabidopsis thaliana* RHM2 (enzyme locus tag AT1G53500) or an empty p425GPD control plasmid was co-transformed. Transformants were pre-grown overnight in 13-ml culture tubes containing 2-3 ml of SC medium lacking leucine, histidine and uracil. The next day, when the culture reached an $OD_{600}$ of 0.4 units it was centrifuged, resuspended in fresh medium, and shaken at 30° C. for 3 days in culture tubes. One hundred μL of culture were spun down; to this an equivalent volume of DMSO was added to the supernatant while 200 μL of 50% DMSO was added to the pellet. Samples were vortexed, heated at 80° C. for 15 minutes, spun down and the steviol glycoside content analyzed by LC-MS.

Analyses of the medium and normalized intracellular content of this strain showed production of RebC. Approximately 8 μM RebC and 4 μM RebA was produced as determined by LC-MS. Furthermore, the intermediates produced following steviol feeding were not detected in this experiment. Accumulation of RebC was strictly dependent on expression of RHM2. This example demonstrates de novo biosynthesis of RebC from glucose.

Production of Additional Steviol Glycosides from Steviol and Glucose

Using the same GPD-based plasmids described above, the stable steviol-producing strain EFSC1923 containing UGT74G1 and UGT85C2 was transformed with the UGTs required to produce RebB (UGT76G1 and UGT91D2e/EUGT11), RebE (UGT91D2e/EUGT11) and dulcoside A (RHM2, UGT91D2e/EUGT11). Wildtype EUGT11 (NCBI: NP_001051007), which was found to have higher diglycosylation activity, was cloned into p424GPD for this experiment. Transformants were pre-grown overnight in 13-ml culture tubes containing 2-3 ml of SC medium lacking leucine, histidine, tryptophan and uracil. The next day, after growth had reached 0.4 $OD_{600}$ units, cells were spun down, resuspended in fresh medium containing 25 μM steviol (except for glucose experiments) and shaken at 30° C. for 3 days in culture tubes. An aliquot of 100 μL of culture was spun down. An equal volume of DMSO was added to the supernatant of this sample while 200 μL of 50% DMSO was added to the pellet. Samples were vortexed, heated at 80° C. for 15 minutes, centrifuged, and the steviol glycoside content analyzed by LC-MS. LC-MS analyses confirmed in vivo production of RebB, RebE, and Dulcoside A in *S. cerevisiae* from glucose or steviol. See, e.g., FIGS. 2A and 2B. A higher concentration of steviol-glycosides was observed following steviol-feeding (as judged by chromatograms).

Characterization of RebF Pathway Intermediates Using EUGT11.

The xylosylating properties of UGT91D2e and EUGT11 were compared in vitro. By using UDP-xylose as the sugar-donor, UGT91D2e was previously shown to xylosylate steviol-13-O-monoglucoside forming a key intermediate in RebF biosynthesis (Publication No. WO/2011/153378). Similar in vitro experiments using EUGT11 and UGT91D2e have shown that these UGTs are capable of xylosylating rubusoside. When UGT91D2e is used, the LC-MS analysis shows a new peak with an m/z ratio corresponding to steviol with 2 glucose molecules and 1 xylose. See, FIG. 26. Because of the shift in the retention time this peak is thought to correspond to rubusoside xylosylated on the 13-O-glucose. When EUGT11 is used, the LC-MS analysis shows two new, similar sized peaks at retention time 3.99 and 4.39 minutes with m/z ratios corresponding to steviol with 2 glucoses and 1 xylose. These products most likely correspond to rubusoside xylosylated on either of the two positions—the 13-O-glucose or the 19-O-glucose.

Production of RebF from Glucose

In vivo production of RebF requires cloning of UGD1 (UDP-glucose dehydrogenase) and USX3 (UDP-glucoronic acid decarboxylase) from *Arabidopsis* for production of UDP-xylose. UGD1 and UXS3 were inserted in a high copy (2μ) vector, derived from P425-GPD, containing two expression cassettes, and expressed from strong constitutive promoters (TPI1 and GPD1, respectively). The plasmid was transformed into the RebA producer strain EFSC2763 (described in Example 21) and cultivated during 3 days in selection medium (SC-leu). The LC-MS results clearly show the appearance of a new peak at retention time 4.13 minutes with m/z ratios corresponding to steviol with 3 glucoses and 1 xylose and identified as RebF (based on a commercial RebF standard), as well as other new peaks with m/z ratios corresponding to steviol with 2 glucoses and 1 xylose (as above), indicating that UGT91D2e was capable of carrying out xylosylation in vivo. These peaks were not seen in the negative controls.

Example 24

Effect of Squalene Synthase (ERG9) Down Regulation Using a Heterologous Insert

In yeast such as *Saccharomyces cerevisiae*, the mevalonate pathway produces a number of isoprenoid phosphate intermediates in the biosynthetic pathway to squalene (See FIG. 20). The squalene synthase in yeast is ERG9. See GenBank Accession No. P29704.2 for the *Saccharomyces cerevisiae* squalene synthase; P36596 for the *Schizosaccharomyces pombe* squalene synthase; Q9Y753 for the *Yarrowia lipolytica* squalene synthase; Q9HGZ6 for the *Candida glabrata* squalene synthase; Q752X9 for the *Ashbya gossypii* squalene synthase; O74165 for the *Cyberlindnera jadinii* squalene synthase; P78589 for the *Candida albicans* squalene synthase; P38604 for the *Saccharomyces cerevisiae* lanosterol synthase; P37268 for the *Homo sapiens* squalene synthase; P53798 for the *Mus musculus* squalene synthase; and Q02769 for the *Rattus norvegicus* squalene synthase. See FIG. 25 (SEQ ID NOs:192-202).

Introduction of Stemloop Structure in 5' UTR of ERGS Gene

The wild-type ERG9 promoter region was replaced with the CYC1 promoter sequence and a 5'UTR sequence by homologous recombination. The 5'UTR region contains a sequence that can form a stemloop structure. See SEQ ID NOs. 181-183. SEQ ID NO:184 is another sequence that also can be used.

```
(heterologous insert 1):
                                        SEQ ID NO: 181
TGAATTCGTTAACGAATTC
```

-continued

```
(heterologous insert 2):
                                    SEQ ID NO: 182
TGAATTCGTTAACGAACTC

(heterologous insert 3):
                                    SEQ ID NO: 183
TGAATTCGTTAACGAAGTC

(heterologous insert 4):
                                    SEQ ID NO: 184
TGAATTCGTTAACGAAATT
```

Without being bound to a particular mechanism, the stemloop may partially block the 5'-3' directed ribosomal scanning for the AUG and reduce the translation of the transcript. Stemloops with different degree of basepairing were tested to find stemloops that reduced the ERG9 transcript translation sufficiently to boost FPP levels without affecting the growth of the yeast strain.

DNA fragments encompassing an ERG9 promoter upstream sequence (for homologous recombination), an expression cassette for the gene (NatR) that confers resistance to Nourseothricin, a CYC1 promoter (SEQ ID NO: 185, FIG. 21), a 5' UTR sequence with a stemloop structure, and an ERG9 ORF sequence (for homologous recombination) were generated by PCR. DNA fragments that contained either the CYC1 promoter or the KEX2 promoter (SEQ ID NO: 186) but no stemloops were also generated as controls. The flanking ERG9 sequences for recombination as well as the stemloop structure were introduced via the PCR oligos. An overview of the construct for homologous recombinantion is shown in FIG. 22. The DNA fragments were transformed into an *S. cerevisiae* host strain that subsequently was selected on nourseothricin containing growth plates. Clones with successful exchange of the native ERG9 promoter with the CYC1 promoter and stemloop-containing 5'UTR sequence were identified. Overview and sequence of the stem-loop region is provided in FIG. 23. The sequence identified as 5% corresponds with the heterologous insert having SEQ ID NO:181; the sequence identified as 20% corresponds with the heterologous insert having SEQ ID NO:182; and the sequence identified as 50% corresponds with the heterologous insert having SEQ ID NO:183.

Assessment of FPP Accumulation (Boosting Effect)

The Amorpha-4,11-diene Synthase (ADS) gene catalyzes the chemical reaction that turns one FPP molecule into Amorpha-4,11-diene in the plant *Artemisia annua*. The gene is functional and efficient in *S. cerevisiae* and can be used to indirectly assess the accumulation of FPP in the strains with the stemloop structure introduced in the heterologous 5'UTR of the ERG9 gene. An *S. cerevisiae* codon optimized nucleic acid encoding ADS (GenBank Accession No. AAF61439) was cloned on a multicopy plasmid (2μ) under the control of the PGK1 promoter and transformed in the wild type and engineered *S. cerevisiae* strains. Amorpha-4,11-diene production was measured and compared to the standard compound caryophyllene, as described by (Ro et al. 2006. *Nature* 440(7086):940-943; Paradise et al. *Biotechnol Bioeng*. 2008 Jun. 1; 100(2):371-8; Newman et al. *Biotechnol Bioeng* 95(4):684-691).

Chemicals

Dodecane and caryophyllene were purchased from Sigma-Aldrich (St. Louis, Mo.). Complete Supplement Mixtures for formulation of Synthetic Complete (SC) media were purchased from Formedium (UK). All others chemical were purchased from Sigma-Aldrich.

Yeast Cultivation

Engineered yeast strains were grown in SC 2% glucose with uracil dropped out. Cultures were grown at 30° C. overnight and then used to inoculate main cultures in 250 mL shake flasks containing 25 mL SC medium, and grown to an optical density of 0.1 at 600 nm. The main cultures were grown for 72 h at 30° C. Because amorphadiene at very low concentrations is volatile from aqueous cultures, 2.5 mL dodecane was added to each culture flask in order to trap and retain the amorphadiene produced. 10 μl of the dodecane layer was sampled and diluted 100 fold in ethyl acetate for quantification by GC-MS GC-MS Analysis of Amorphadiene GC-MS was used to measure amorphadiene production from yeast cultures. Samples were analysed using the method as follow: The GC oven temperature program used 80° C. for 2 min, followed by a ramping of 30° C./min to 160° C., then 3° C./min up to 170° C., and finally 30° C./min up to 300° C. with a 2 min final hold. Injector and MS quadrupole detector temperatures were 250° C. and 150° C., respectively. 1 μL was injected in split less mode. The MS was operated in full scan mode. Amorphadiene concentration was calculated in (−)-tran-caryophyllene equivalents using a caryophyllene standard curve using the total ions.

Figure 24:
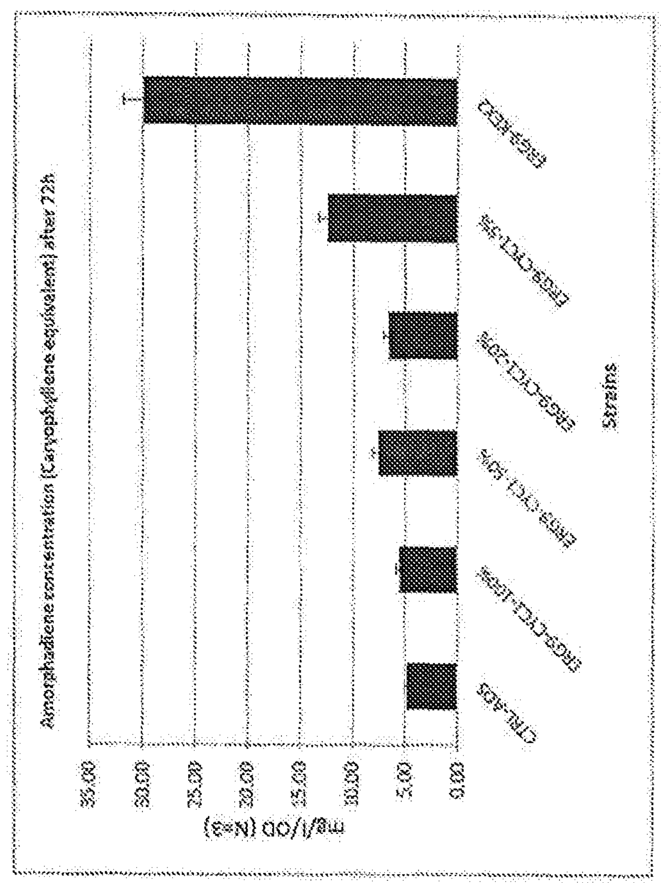
FIG. 24 is a bar graph showing amorphadiene produced in yeast strains with different promoter constructs inserted in front of the ERG9 gene of the host genome. CTRL-ADS refers to control strain with no modification; ERG9-CYC1-100% refers to construct comprising the ScCyc1 promoter and no insert; ERG9-CYC1-50% refers to construct comprising the ScCyc1 promoter followed by SEQ ID NO: 183 (SEQ ID NO:190); ERG9-CYC1-20% refers to construct comprising the ScCyc1 promoter followed by SEQ ID NO: 182 (SEQ ID NO:189); ERG9-CYC1-5% refers to construct comprising the ScCyc1 promoter followed by SEQ ID NO: 181 (SEQ ID NO:188); ERG9-KEX2-100% refers to construct comprising the ScKex2 promoter.

The analysis of the different strains, including the different promoter constructs, showed an increased production of amorphadiene ((2.5×) when using the heterologous insert having the nucleotide sequence set forth in SEQ ID NO: 181 compared to either no insert or the inserts having the nucleotide sequences set forth in SEQ ID NO:182 and 183. See FIG. 24. The heterologous insert set forth in SEQ ID NO:181 has the most stable secondary structure. For comparison the wild type yeast, with unmodified ERG9, was also analyzed (FIG. 24: CTRL-ADS) and this strain showed even lower production of amorphadiene. Conversely, the construct that comprised the very weak promoter ScKex2 showed an even higher level of amorphadiene (6×).

Example 25

Analysis of the Effect of Squalene Synthase (ERG9) Down Regulation and GGPPS Overexpression on GGPP Production Assessment of GGPP Accumulation

*S. cerevisiae* contains a GGPPS (BTS1). In addition to BTS1 there are several heterologous GGPPS enzymes that are functional and efficient in *S. cerevisiae*. When a functional GGPPS is overexpressed in *S. cerevisiae*, it leads to accumulation of GGPP, which may be converted to geranylgeraniol (GGOH) by the *S. cerevisiae* enzymes DPP1 and LPP1. The GGOH is partly exported to the yeast culture medium. GGOH can be measured by GC-MS and its accumulation can indirectly be used to assess the potential pool of GGPP that is available for enzymes that use GGPP as substrate.

Four different GGPPSs (GGPPS-1 (*S. acidicaldarius*, see Table 7), GGPPS-2 (*A. nidulans*, FIG. 25, SEQ ID NO:203), GGPPS-3 (*S. cerevisiae*, BTS1, FIG. 25, SEQ ID NO:167), and GGPPS-4 (*M. musculus*, see Table 7)) were assessed. The nucleotide sequences encoding GGPPS-1, GGPPS-2, and GGPPS-4 were *S. cerevisiae* codon optimized. All nucleic acids encoding the GGPPS polypeptides were cloned on a multitcopy plasmid (20 under the control of the PGK1 promoter and transformed in two different ERG9 down regulated strains: KEX2-ERG9 and CYC1(5%)-ERG9 (see Example 24).

Engineered yeast strains were grown in SC 2% glucose with uracil dropped out. Complete Supplement Mixtures for formulation of Synthetic Complete (SC) media were purchased from Formedium (UK). All others chemical were purchased from Sigma-Aldrich (St. Louis, Mo.). All optical density measurements were done at OD 600 nm. Cultures were grown at 30° C. overnight and then used to inoculate 250 ml unbaffled culture flasks containing 25 ml SC medium at an OD600 of 0.1. The main cultures were grown for 72 h at 30° C.

To measure GGOH accumulation, yeast cells (pellet) and yeast culture medium (supernatant) were extracted separately and then combined before analysis by GC-MS. The supernatant was extracted with Hexane in a 1:1 ratio. The pellet was first subjected to a saponification in solution containing 20% KOH and 50% Ethanol and the lysed cells were finally extracted with Hexane in a 1:1 ratio. The GC oven temperature program used was 80° C. for 2 min, followed by a ramp to 160° C. at 30° C./min, then to 170° C. at 3° C./min and finally to 300° C. at 30° C./min with a 2 min hold. Injector and MS quadrupole detector temperatures were 250° C. and 150° C., respectively. 2 ul was injected in split less mode. The MS was operated in full scan mode.

Figure 26:
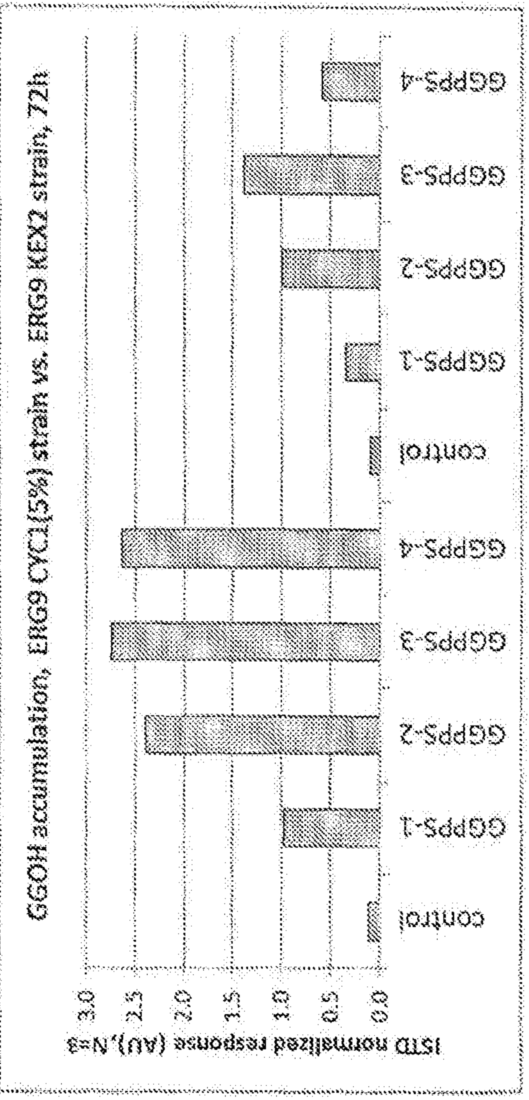
FIG. 26 is a bar graph of geranylgeraniol (GGOH) accumulation in the ERG9-CYC1-5% strain and ERG9-KEX2 strain after 72 hours.
Figure 27:
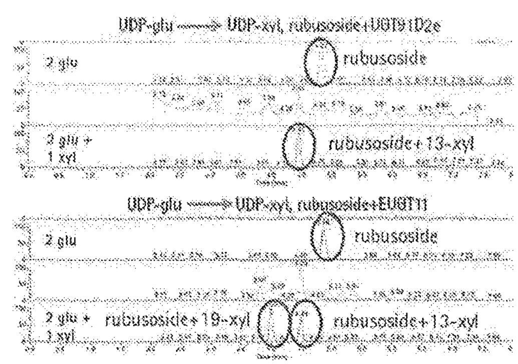
FIG. 27 is a representative chromatograph showing the conversion of rubusoside to xylosylated intermediates for RebF production by UGT91D2e and EUGT11.

When the GGPPS were overexpressed in the CYC1 (5%)-ERG9 strain or KEX2-ERG9 strain, there was a significant increase in GGOH (GGPP) production observed with all four GGPPS polypeptides compared to the control where no GGPPS was expressed. Notably, the CYC1 (5%)-ERG9 strain showed a 2-4 fold higher GGOH (GGPP) accumulation than the KEX2-ERG9 strain. The results are shown in FIG. 26.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (205 sequences)

SEQ ID NO: 1 - protein, 460 aa, Stevia rebaudiana
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 2 - DNA, 1383 bp, Stevia rebaudiana
atggcagagcaacaaaagatcaaaaagtcacctcacgtcttacttattccatttcctctgcaaggacatatcaacccattcatacaatttgggaaaagattgattagtaagggtgtaaagacaacactggtaaccactatccacactttgaattctactctgaaccactcaaatactactactacaagtatagaaattcaagctatatcagacggatgcgatgagggtggctttatgtctgccggtgaatcttacttggaaacattcaagcaagtgggatccaagtctctggccgatctaatcaaaaagttacagagtgaaggcaccacaattgacgccataatctacgattctatgacagagtgggttttagacgttgctatcgaatttggtattgatggaggttcctttttcacacaagcatgtgttgtgaattctctatactaccatgtgcataaagggttaatctctttaccattgggtgaaactgtttcagttccaggttttccagtgttacaacgttgggaaaccccattgatcttacaaaatcatgaacaaatacaatcaccttggtcccagatgttgtttggtcaattcgctaacatcgatcaagcaagatgggtctttactaattcattctataagttagaggaagaggtaattgaatggactaggaagatctggaatttgaaagtcattggtccaacattgccatcaatgtatttggacaaaagacttgatgatgataaagataatggtttcaatttgtacaaggctaatcatcacgaatgtatgaattggctggatgacaaaccaaaggaatcagttgtatatgttgctttcggctctcttgttaaacatggtccagaacaagttgaggagattacaagagcacttatagactctgacgtaaactttttgtgggtcattaagcacaaagaggaggggaaactgccagaaaacctttctgaagtgataaagaccggaaaaggtctaatcgttgcttggtgtaaacaattggatgttttagctcatgaatctgtaggctgttttgtaacacattgcggattcaactctacactagaagccatttccttaggcgtacctgtcgttgcaatgcctcagttctccgatcagacaaccaacgctaaacttttggacgaaatactaggggtgggtgtcagagttaaagcagacgagaatggtatcgtcagaagagggaacctagcttcatgtatcaaaatgatcatggaagaggaaagaggagttatcataaggaaaaacgcagttaagtggaaggatcttgcaaaggttgccgtccatgaaggcggctcttcagataatgatattgttgaatttgtgtccgaactaatcaaagcctaa

SEQ ID NO: 3 - protein, 481 aa, Stevia rebaudiana
MDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 4 - DNA, 1446 bp, Stevia rebaudiana
atggatgcaatggcaactactgagaaaaagcctcatgtgatcttcattccatttcctgcacaatctcacataaaggcaatgctaaagttagcacaactattacaccataagggattacagataactttcgtgaataccgacttcatccataatcaatttctggaatctagtggccctcattgtttggacggagccccagggtttagattcgaaacaattcctgacggtgtttcacattccccagaggcctccatcccaataagagagagtttactgaggtcaatagaaaccaactttttggatcgtttcattgacttggtcacaaaacttccagacccaccaacttgcataatctctgatggctttctgtcagtgtttactatcgacgctgccaaaaagttgggtatcccagttatgatgtactggactcttgctgcatgcggtttcatgggtttctatcacatccattctcttatcgaaaagggttttgctccactgaaagatgcatcatacttaaccaacggctacctggatactgttattgactgggtaccaggtatggaaggtataagacttaaagattttcctttggattggtctacagaccttaatgataaagtattgatgtttactacagaagctccacaaagatctcataaggtttcacatcatatctttcacacctttgatgaattggaaccatcaatcatcaaaaccttgtctctaagatacaatcatatctacactattggtccattacaattacttctagatcaaattcctgaagagaaaaagcaaactggtattacatccttacacggctactctttagtgaaagaggaaccagaatgttttcaatggctacaaagtaaagagcctaattctgtggtctacgtcaacttcggaagtacaacagtcatgtccttggaagatatgactgaatttggttggggccttgctaattcaaatcattactttctatggattatcaggtccaatttggtaataggggaaaacgccgtattacctccagaattggaggaacacatcaaaaagagaggtttcattgcttcctggtgttctcaggaaaaggtattgaaacatccttctgttggtggtttccttactcattgcggttggggctctacaatcgaatcactaagtgcaggagttccaatgatttgttggccatattcatgggaccaacttacaaattgtaggtatatctgtaaagagtgggaagttggattagaaatgggaacaaaggttaaacgtgatgaagtgaaaagattggttcaggagttgatgggggaaggtggccacaagatgagaaacaaggccaaagattggaaggaaaaagccagaattgctattgctcctaacgggtcatcctctctaaacattgataagatggtcaaagagattacagtcttagccagaaactaa

SEQ ID NO: 5 - protein, 473 aa, Stevia rebaudiana
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 6 - DNA, 1422 bp, Stevia rebaudiana
atggctacatctgattctattgttgatgacaggaagcagttgcatgtggctactttcccttggcttgctttcggtcatatactgccttacctacaactatcaaaactgatagctgaaaaaggacataaagtgtcattcctttcaacaactagaaacattcaaagattatcttcccacatatcaccattgattaacgtcgttcaattgacacttccaagagtacaggaattaccagaagatgctgaagctacaacagatgtgcatcctgaagatatcccttacttgaaaaaggcatccgatggattacagcctgaggtcactagattccttgagcaacacagtccagattggatcatatacgactacactcactattggttgccttcaattgcagcatcactaggcatttctagggcacatttcagtgtaaccacaccttgggccattgcttacatgggtccatccgctgatgctatgattaacggcagtgatggtagaactaccgttgaagatttgacaaccccaccaaagtggtttccatttccaactaaagtctgttggagaaaacacgacttagcaagactggttccatacaaggcaccaggaatctcagacggctatagaatgggtttagtccttaaagggtctgactgcctattgtctaagtgttaccatgagtttgggacacaatggctaccacttttggaaacattacaccaagttcctgtcgtaccagttggtctattacctccagaaatccctggtgatgagaaggacgagacttgggtttcaatcaaaaagtggttagacgggaagcaaaaaggctcagtggtatatgtggcactgggttccgaagttttagtatctcaaacagaagttgtggaacttgccttaggtttggaactatctggattgccatttgtctgggcctacagaaaaccaaaaggccctgcaaagtccgattcagttgaattgccagacggctttgtcgagagaactagagatagagggttggtatggacttcatgggctccacaattgagaatcctgagtcacgaatctgtgtgcggtttcctaacacattgtggttctggttctatagttgaaggactgatgtttggtcatccacttatcatgttgccaatctttggtgaccagcctttgaatgcacgtctgttagaagataaacaagttggaattgaaatcccacgtaatgaggaagatggatgtttaaccaaggagtctgtggccagatcattacgttccgttgtcgttgaaaaggaaggcgaaatctacaaggccaatgcccgtgaactttcaaagatctacaatgacacaaaagtagagaaggaatatgtttctcaatttgtagattacctagagaaaaacgctagagccgtagctattgatcatgaatcctaa

SEQ ID NO: 7 - protein, 458 aa, Stevia rebaudiana
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 8 - DNA, 1377 bp, Stevia rebaudiana
atggaaaacaagaccgaaacaacagttagacgtaggcgtagaatcattctgtttccagtaccttttcaagggcacatcaatccaatactacaactagccaacgttttgtactctaaaggtttttctattacaatctttcacaccaatttcaacaaaccaaaaacatccaattacccacatttcacattcagattcatacttgataatgatccacaagatgaacgtatttcaaacttacctacccacggtcctttagctggaatgagaattccaatcatcaatgaacatggtgccgatgagcttagaagagaattagagttacttatgttggcatccgaagaggacgaggaagtctcttgtctgattactgacgctctatggtactttgcccaatctgtggctgatagtttgaatttgaggagattggtactaatgacatccagtctgtttaactttcacgctcatgttagtttaccacaatttgacgaattgggatacttggaccctgatgacaagactaggttagaggaacaggcctctggttttcctatgttgaaagtcaaagatatcaagtctgcctattctaattggcaaatcttgaaagagatcttaggaaagatgatcaaacagacaaaggcttcatctggagtgatttggaacagtttcaaagagttagaagagtctgaattggagactgtaatcagagaaattccagcaccttcattcctgataccattaccaaaacatttgactgcttcctcttcctctttgttggatcatgacagaacagtttttcaatggttggaccaacaaccacctagttctgttttgtacgtgtcatttggtagtacttctgaagtcgatgaaaaggacttccttgaaatcgcaagaggcttagtcgatagtaagcagtcattcctttgggtcgtgcgtccaggtttcgtgaaaggctcaacatgggtcgaaccacttccagatggttttctaggcgaaagaggtagaatagtcaaatgggttcctcaacaggaagttttagctcatggcgctattggggcattctggactcattccggatggaattcaactttagaatcagtatgcgaaggggtacctatgatcttttcagattttggtcttgatcaaccactgaacgcaagatacatgtctgatgttttgaaagtgggtgtatatctagaaaatggctgggaaaggggtgaaatagctaatgcaataagacgtgttatggttgatgaagagggggagtatatcagacaaaacgcaagagtgctgaagcaaaaggccgacgtttctctaatgaagggaggctcttcatacgaatccttagaatctcttgtttcctacatttcatcactgtaa

SEQ ID NO: 9 - DNA, 1422 bp, Stevia rebaudiana
atggctaccagtgactccatagttgacgaccgtaagcagcttcatgttgcgacgttcccatggcttgctttcggtcacatcctcccttaccttcagctttcgaaattgatagctgaaaagggtcacaaagtctcgtttctttctaccaccagaaacattcaacgtctctcttctcatatctcgccactcataaatgttgttcaactcacacttccacgtgtccaagagctgccggaggatgcagaggcgaccactgacgtccaccctgaagatattccatatctcaagaaggcttctgatggtcttcaaccggaggtcacccggtttctagaacaacactctccggactggattatttatgattatactcactactggttgccatccatcgcggctagcctcggtatctcacgagcccacttctccgtcaccactccatgggccattgcttatatgggaccctcagctgacgccatgataaatggttcagatggtcgaaccacggttgaggatctcacgacaccgcccaagtggtttccctttccgaccaaagtatgctggcggaagcatgatcttgcccgactggtgccttacaaagctccggggatatctgatggataccgtatggggctggttcttaagggatctgattgtttgctttccaaatgttaccatgagtttggaactcaatggctacctcttttggagacactacaccaagtaccggtggttccggtgggattactgccaccggaaatacccggagacgagaaagatgaaacatgggtgtcaatcaagaaatggctcgatggtaaacaaaaaggcagtgtggtgtacgttgcattaggaagcgaggttttggtgagccaaaccgaggttgttgagttagcattgggtctcgagctttctgggttgccatttgtttgggcttatagaaaaccaaaaggtcccgcgaagtcagactcggtggagttgccagacgggttcgtggaacgaactcgtgaccgtgggttggtctggacgagttgggcacctcagttacgaatactgagccatgagtcggtttgtggtttcttgactcattgtggttctggatcaattgtggaagggctaatgtttggtcaccctctaatcatgctaccgatttttggggaccaacctctgaatgctcgattactggaggacaaacaggtgggaatcgagataccaagaaatgaggaagatggttgcttgaccaaggagtcggttgctagatcactgaggtccgttgttgtggaaaaagaaggggagatctacaaggcgaacgcgagggagctgagtaaaatctataacgacactaaggttgaaaaagaatatgtaagccaattcgtagactatttggaaaagaatgcgcgtgcggttgccatcgatcatgagagttaa

SEQ ID NO: 10 - protein, 473 aa, Stevia rebaudiana
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEVPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNTRAVAIDHES

SEQ ID NO: 11 - DNA, 1422 bp, Stevia rebaudiana
atggctaccagtgactccatagttgacgaccgtaagcagcttcatgttgcgacgttcccatggcttgctttcggtcacatcctcccttaccttcagctttcgaaattgatagctgaaaagggtcacaaagtctcgtttctttctaccaccagaaacattcaacgtctctcttctcatatctcgccactcataaatgttgttcaactcacacttccacgtgtccaagagctgccggaggatgcagaggcgaccactgacgtccaccctgaagatattccatatctcaagaaggcttctgatggtcttcaaccggaggtcacccggtttctagaacaacactctccggactggattatttatgattatactcactactggttgccatccatcgcggctagcctcggtatctcacgagcccacttctccgtcaccactccatgggccattgcttatatgggaccctcagctgacgccatgataaatggttcagatggtcgaaccacggttgaggatctcacgacaccgcccaagtggtttccctttccgaccaaagtatgctggcggaagcatgatcttgcccgactggtgccttacaaagctccggggatatctgatggataccgtatggggctggttcttaagggatctgattgtttgctttccaaatgttaccatgagtttggaactcaatggctacctcttttggagacactacaccaagtaccggtggttccggtgggattactgccaccggaagtacccggagacgagaaagatgaaacatgggtgtcaatcaagaaatggctcgatggtaaacaaaaaggcagtgtggtgtacgttgcattaggaagcgaggttttggtgagccaaaccgaggttgttgagttagcattgggtctcgagctttctgggttgccatttgtttgggcttatagaaaaccaaaaggtcccgcgaagtcagactcggtggagttgccagacgggttcgtggaacgaactcgtgaccgtgggttggtctggacgagttgggcacctcagttacgaatactgagccatgagtcggtttgtggtttcttgactcattgtggttctggatcaattgtggaagggctaatgtttggtcaccctctaatcatgctaccgatttttggggaccaacctctgaatgctcgattactggaggacaaacaggtgggaatcgagataccaagaaatgaggaagatggttgcttgaccaaggagtcggttgctagatcactgaggtccgttgttgtggaaaaagaaggggagatctacaaggcgaacgcgagggagctgagtaaaatctataacgacactaaggttgaaaaagaatatgtaagccaattcgtagactatttggaaaagaatacgcgtgcggttgccatcgatcatgagagttaa

SEQ ID NO: 12 - protein, 473 aa, Stevia rebaudiana
MATSDSIVDDRKQLHVATFPWLAFGHILPFLQLSKLIAEKGHKVSFLSTTRNIQRLSSHISPLINVVQLTLPRVQELPEDAEATTDVHPEDIQYLKKAVDGLQPEVTRFLEQHSPDWIIYDFTHYWLPSIAASLGISRAYFCVITPWTIAYLAPSSDAMINDSDGRTTVEDLTTPPKWFPFPTKVCWRKHDLARMEPYEAPGISDGYRMGMVFKGSDCLLFKCYHEFGTQWLPLLETLHQVPVVPVGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPLFGDQPLNARLLEDKQVGIEIPRNEEDGCLTKESVARSLRSVVVENEGEIYKANARELSKIYNDTKVEKEYVSQFVDYLEKNARAVAIDHES

SEQ ID NO: 13 - DNA, 1422 bp, Stevia rebaudiana
atggctaccagtgactccatagttgacgaccgtaagcagcttcatgttgcgacgttcccatggcttgctttcggtcacatcctccctttccttcagctttcgaaattgatagctgaaaagggtcacaaagtctcgtttctttctaccaccagaaacattcaacgtctctcttctcatatctcgccactcataaatgttgttcaactcacacttccacgtgtccaagagctgccggaggatgcagaggcgaccactgacgtccaccctgaagatattcaatatctcaagaaggctgttgatggtcttcaaccggaggtcacccggtttctagaacaacactctccggactggattatttatgattttactcactactggttgccatccatcgcggctagcctcggtatctcacgagcctacttctgcgtcatcactccatggaccattgcttatttggcaccctcatctgacgccatgataaatgattcagatggtcgaaccacggttgaggatctcacgacaccgcccaagtggtttccctttccgaccaaagtatgctggcggaagcatgatcttgcccgaatggagccttacgaagctccagggatatctgatggataccgtatggggatggtttttaagggatctgattgtttgcttttcaaatgttaccatgagtttggaactcaatggctacctcttttggagacactacaccaagtaccggtggttccggtgggattactgccgccggaaatacccggagacgagaaagatgaaacatgggtgtcaatcaagaaatggctcgatggtaaacaaaaaggcagtgtggtgtacgttgcattaggaagcgaggctttggtgagccaaaccgaggttgttgagttagcattgggtctcgagctttctgggttgccatttgtttgggcttatagaaaaccaaaaggtcccgcgaagtcagactcggtggagttgccagacgggttcgtggaacgaactcgtgaccgtgggttggtctggacgagttgggcacctcagttacgaatactgagccatgagtcggtttgtggtttcttgactcattgtggttctggatcaattgtggaagggctaatgtttggtcaccctctaatcatgctaccgctttttggggaccaacctctgaatgctcgattactggaggacaaacaggtgggaatcgagataccaagaaatgaggaagatggttgcttgaccaaggagtcggttgctagatcactgaggtccgttgttgtggaaaacgaaggggagatctacaaggcgaacgcgagggagctgagtaaaatctataacgacactaaggtggaaaaagaatatgtaagccaattcgtagactatttggaaaagaatgcgcgtgcggttgccatcgatcatgagagttaa

SEQ ID NO: 14 - protein, 485 aa, Stevia rebaudiana
MYNVTYHQNSKAMATSDSIVDDRKQLHVATFPWLAFGHILPFLQLSKLIAEKGHKVSFLSTTRNIQRLSSHISPLINVVQLTLPRVQELPEDAEATTDVHPEDIQYLKKAVDGLQPEVTRFLEQHSPDWIIYDFTHYWLPSIAASLGISRAYFCVITPWTIAYLAPSSDAMINDSDGRTTVEDLTTPPKWFPFPTKVCWRKHDLARMEPYEAPGISDGYRMGMVFKGSDCLLFKCYHEFGTQWLPLLETLHQVPVVPVGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPIFCDQPLNARLLEDKQVGIEIPRNEEDGCLTKESVARSLRSVVVENEGEIYKANARALSKIYNDTKVEKEYVSQFVDYLEKNARAVAIDHES

SEQ ID NO: 15 - DNA, 1458 bp, Stevia rebaudiana
atgtacaacgttacttatcatcaaaattcaaaagcaatggctaccagtgactccatagttgacgaccgtaagcagcttcatgttgcgacgttcccatggcttgctttcggtcacatcctccctttccttcagctttcgaaattgatagctgaaaagggtcacaaagtctcgtttctttctaccaccagaaacattcaacgtctctcttctcatatctcgccactcataaatgttgttcaactcacacttccacgtgtccaagagctgccggaggatgcagaggcgaccactgacgtccaccctgaagatattcaatatctcaagaaggctgttgatggtcttcaaccggaggtcacccggtttctagaacaacactctccggactggattatttatgattttactcactactggttgccatccatcgcggctagcctcggtatctcacgagcctacttctgcgtcatcactccatggaccattgcttatttggcaccctcatctgacgccatgataaatgattcagatggtcgaaccacggttgaggatctcacgacaccgcccaagtggtttccctttccgaccaaagtatgctggcggaagcatgatcttgcccgaatggagccttacgaagctccggggatatctgatggataccgtatggggatggtttttaagggatctgattgtttgcttttcaaatgttaccatgagtttggaactcaatggctacctcttttggagacactacaccaagtaccggtggttccggtgggattactgccgccggaaatacccggagacgagaaagatgaaacatgggtgtcaatcaagaaatggctcgatggtaaacaaaaaggcagtgtggtgtacgttgcattaggaagcgaggctttggtgagccaaaccgaggttgttgagttagcattgggtctcgagctttctgggttgccatttgtttgggcttatagaaaaccaaaaggtcccgcgaagtcagactcggtggagttgccagacgggttcgtggaacgaactcgtgaccgtgggttggtctggacgagttgggcacctcagttacgaatactgagccacgagtcagtttgtggtttcttgactcattgtggttctggatcaattgtggaagggctaatgtttggtcaccctctaatcatgctaccgattttttgtgaccaacctctgaatgctcgattactggaggacaaacaggtgggaatcgagataccaagaaatgaggaagatggttgcttgaccaaggagtcggttgctagatcactgaggtccgttgttgtggaaaacgaaggggagatctacaaggcgaacgcgagggcgctgagtaaaatctataacgacactaaggtggaaaaagaatatgtaagccaattcgtagactatttggaaaagaatgcgcgtgcggttgccatcgatcatgagagttaa

SEQ ID NO: 16 - protein, 473 aa, Stevia rebaudiana
MATSDSIVDDRKQLHVATFPWLAFGHILPFLQLSKLIAEKGHKVSFLSTTRNIQRLSSHISPLINVVQLTLPRVQELPEDAEATTDVHPEDIQYLKKAVDGLQPEVTRFLEQHSPDWIIYDFTHYWLPSIAASLGISRAYFCVITPWTIAYLAPSSDAMINDSDGRTTVEDLTTPPKWFPFPTKVCWRKHDLARMEPYEAPGISDGYRMGMVFKGSDCLLFKCYHEFGTQWLPLLETLHQVPVVPVGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPIFCDQPLNARLLEDKQVGIEIPRNEEDGCLTKESVARSLRSVVVENEGEIYKANARALSKIYNDTKVEKEYVSQFVDYLEKNARAVAIDHES

SEQ ID NO: 17 - DNA, 1422 bp, Stevia rebaudiana
atggctaccagtgactccatagttgacgaccgtaagcagcttcatgttgcgacgttcccatggcttgctttcggtcacatcctccctttccttcagctttcgaaattgatagctgaaaagggtcacaaagtctcgtttctttctaccaccagaaacattcaacgtctctcttctcatatctcgccactcataaatgttgttcaactcacacttccacgtgtccaagagctgccggaggatgcagaggcgaccactgacgtccaccctgaagatattcaatatctcaagaaggctgttgatggtcttcaaccggaggtcacccggtttctagaacaacactctccggactggattatttatgattttactcactactggttgccatccatcgcggctagcctcggtatctcacgagcctacttctgcgtcatcactccatggaccattgcttatttggcaccctcatctgacgccatgataaatgattcagatggtcgaaccacggttgaggatctcacgacaccgcccaagtggtttccctttccgaccaaagtatgctggcggaagcatgatcttgcccgaatggagccttacgaagctccggggatatctgatggataccgtatggggatggtttttaagggatctgattgtttgcttttcaaatgttaccatgagtttggaactcaatggctacctcttttggagacactacaccaagtaccggtggttccggtgggattactgccgccggaaatacccggagacgagaaagatgaaacatgggtgtcaatcaagaaatggctcgatggtaaacaaaaaggcagtgtggtgtacgttgcattaggaagcgaggctttggtgagccaaaccgaggttgttgagttagcattgggtctcgagctttctgggttgccatttgtttgggcttatagaaaaccaaaaggtcccgcgaagtcagactcggtggagttgccagacgggttcgtggaacgaactcgtgaccgtgggttggtctggacgagttgggcacctcagttacgaatactgagccacgagtcagtttgtggtttcttgactcattgtggttctggatcaattgtggaagggctaatgtttggtcaccctctaatcatgctaccgattttttgtgaccaacctctgaatgctcgattactggaggacaaacaggtgggaatcgagataccaagaaatgaggaagatggttgcttgaccaaggagtcggttgctagatcactgaggtccgttgttgtggaaaacgaaggggagatctacaaggcgaacgcgagggcgctgagtaaaatctataacgacactaaggtggaaaaagaatatgtaagccaattcgtagactatttggaaaagaatgcgcgtgcggttgccatcgatcatgagagttaa

SEQ ID NO: 18 - DNA, 1086 bp, Artificial Sequence
  Description of Artificial Sequence: Synthetic polynucleotide
atggctttggtaaacccaaccgctcttttctatggtacctctatcagaacaagacctacaaacttactaaatccaactcaaaagctaagaccagtttcatcatcttccttaccttctttctcatcagttagtgcgattcttactgaaaaacatcaatctaatccttctgagaacaacaatttgcaaactcatctagaaactcctttcaactttgatagttatatgttggaaaaagtcaacatggttaacgaggcgcttgatgcatctgtcccactaaaagacccaatcaaaatccatgaatccatgagatactctttattggcaggcggtaagagaatcagaccaatgatgtgtattgcagcctgcgaaatagtcggaggtaatatccttaacgccatgccagccgcatgtgccgtggaaatgattcatactatgtctttggtgcatgacgatcttccatgtatggataatgatgacttcagaagaggtaaacctatttcacacaaggtctacggggaggaaatggcagtattgaccggcgatgctttactaagtttatctttcgaacatatagctactgctacaaagggtgtatcaaaggatagaatcgtcagagctataggggagttggcccgttcagttggctccgaaggtttagtggctggacaagttgtagatatcttgtcagagggtgctgatgttggattagatcacctagaatacattcacatccacaaaacagcaatgttgcttgagtcctcagtagttattggcgctatcatgggaggaggatctgatcagcagatcgaaaagttgagaaaattcgctagatctattggtctactattccaagttgtggatgacattttggatgttacaaaatctaccgaagagttggggaaaacagctggtaaggatttgttgacagataagacaacttacccaaagttgttaggtatagaaaagtccagagaatttgccgaaaaacttaacaaggaagcacaagagcaattaagtggctttgatagacgtaaggcagctcctttgatcgcgttagccaactacaatgcgtaccgtcaaaattga

SEQ ID NO: 19 - DNA, 1029 bp, Artificial Sequence
  Description of Artificial Sequence: Synthetic polynucleotide
atggctgagcaacaaatatctaacttgctgtctatgtttgatgcttcacatgctagtcagaaattagaaattactgtccaaatgatggacacataccattacagagaaacgcctccagattcctcatcttctgaaggcggttcattgtctagatacgacgagagaagagtctctttgcctctcagtcataatgctgcctctccagatattgtatcacaactatgtttttccactgcaatgtcttcagagttgaatcacagatggaaatctcaaagattaaaggtggccgattctccttacaactatatcctaacattaccatcaaaaggaattagaggtgcctttatcgattccctgaacgtatggttggaggttccagaggatgaaacatcagtcatcaaggaagttattggtatgctccacaactcttcattaatcattgatgacttccaagataattctccacttagaagaggaaagccatctacccatacagtcttcggccctgcccaggctatcaatactgctacttacgttatagttaaagcaatcgaaaagatacaagacatagtgggacacgatgcattggcagatgttacgggtactattacaactattttccaaggtcaggccatggacttgtggtggacagcaaatgcaatcgttccatcaatacaggaatacttacttatggtaaacgataaaaccggtgctctctttagactgagtttggagttgttagctctgaattccgaagccagtatttctgactctgctttagaaagtttatctagtgctgtttccttgctaggtcaatacttccaaatcagagacgactatatgaacttgatcgataacaagtatacagatcagaaaggcttctgcgaagatcttgatgaaggcaagtactcactaacacttattcatgccctccaaactgattcatccgatctactgaccaacatcctttcaatgagaagagtgcaaggaaagttaacggcacaaaagagatgttggttctggaaatga

SEQ ID NO: 20 - DNA, 903 bp, Artificial Sequence
  Description of Artificial Sequence: Synthetic polynucleotide
atggaaaagactaaggagaaagcagaacgtatcttgctggagccatacagatacttattacaactaccaggaaagcaagtccgttctaaactatcacaagcgttcaatcactggttaaaagttcctgaagataagttacaaatcattattgaagtcacagaaatgctacacaatgcttctttactgatcgatgatatagaggattcttccaaactgagaagaggttttcctgtcgctcattccatatacggggtaccaagtgtaatcaactcagctaattacgtctacttcttgggattggaaaaagtattgacattagatcatccagacgctgtaaagctattcaccagacaacttcttgaattgcatcaaggtcaaggtttggatatctattggagagacacttatacttgcccaacagaagaggagtacaaagcaatggttctacaaaagactggcggtttgttcggacttgccgttggtctgatgcaacttttctctgattacaaggaggacttaaagcctctgttggataccttgggcttgtttttccagattagagatgactacgctaacttacattcaaaggaatattcagaaaacaaatcattctgtgaagatttgactgaagggaagtttagttttccaacaatccacgccatttggtcaagaccagaatctactcaagtgcaaaacattctgcgtcagagaacagagaatattgacatcaaaaagtattgtgttcagtacttggaagatgttggttcttttgcttacacaagacatacacttagagaattagaggcaaaagcatacaagcaaatagaagcctgtggaggcaatccttctctagtggcattggttaaacatttgtccaaaatgttcaccgaggaaaacaagtaa

SEQ ID NO: 21 - DNA, 1020 bp, Artificial Sequence
  Description of Artificial Sequence: Synthetic polynucleotide
atggcaagattctattttcttaacgcactattgatggttatctcattacaatcaactacagccttcactccagctaaacttgcttatccaacaacaacaacagctctaaatgtcgcctccgccgaaacttctttcagtctagatgaatacttggcctctaagataggacctatagagtctgccttggaagcatcagtcaaatccagaattccacagaccgataagatctgcgaatctatggcctactctttgatggcaggaggcaagagaattagaccagtgttgtgtatcgctgcatgtgagatgttcggtggatcccaagatgtcgctatgcctactgctgtggcattagaaatgatacacacaatgtctttgattcatgatgatttgccatccatggataacgatgacttgagaagaggtaaaccaacaaaccatgtcgttttcggcgaagatgtagctattcttgcaggtgactctttattgtcaacttccttcgagcacgtcgctagagaaacaaaaggagtgtcagcagaaaagatcgtggatgttatcgctagattaggcaaatctgttggtgccgagggccttgctggcggtcaagttatggacttagaatgtgaagctaaaccaggtaccacattagacgacttgaaatggattcatatccataaaaccgctacattgttacaagttgctgtagcttctggtgcagttctaggtggtgcaactcctgaagaggttgctgcatgcgagttgtttgctatgaatataggtcttgcctttcaagttgccgacgatatccttgatgtaaccgcttcatcagaagatttgggtaaaactgcaggcaaagatgaagctactgataagacaacttacccaaagttattaggattagaagagagtaaggcatacgcaagacaactaatcgatgaagccaaggaaagtttggctccttttggagatagagctgcccctttattggccattgcagatttcattattgatagaaagaattga

SEQ ID NO: 22 - DNA, 1068 bp, Artificial Sequence
  Description of Artificial Sequence: Synthetic polynucleotide
atgcacttagcaccacgtagagtccctagaggtagaagatcaccacctgacagagttcctgaaagacaaggtgccttgggtagaagacgtggagctggctctactggctgtgcccgtgctgctgctggtgttcaccgtagaagaggaggaggcgaggctgatccatcagctgctgtgcatagaggctggcaagccggtggtggcaccggtttgcctgatgaggtggtgtctaccgcagccgccttagaaatgtttcatgcttttgctttaatccatgatgatatcatggatgatagtgcaactagaagaggctccccaactgttcacagagccctagctgatcgtttaggcgctgctctggacccagatcaggccggtcaactaggagtttctactgctatcttggttggagatctggctttgacatggtccgatgaattgttatacgctccattgactccacatagactggcagcagtactaccattggtaacagctatgagagctgaaaccgttcatggccaatatcttgatataactagtgctagaagacctgggaccgatacttctcttgcattgagaatagccagatataagacagcagcttacacaatggaacgtccactgcacattggtgcagccctggctggggcaagaccagaactattagcagggctttcagcatacgccttgccagctggagaagccttccaattggcagatgacctgctaggcgtcttcggtgatccaagacgtacagggaaacctgacctagatgatcttagaggtggaaagcatactgtcttagtcgccttggcaagagaacatgccactccagaacagagacacacattggatacattattgggtacaccaggtcttgatagacaaggcgcttcaagactaagatgcgtattggtagcaactggtgcaagagccgaagccgaaagacttattacagagagaagagatcaagcattaactgcattgaacgcattaacactgccacctcctttagctgaggcattagcaagattgacattagggtctacagctcatcctgcctaa

SEQ ID NO: 23 - DNA, 993 bp, Artificial Sequence
  Description of Artificial Sequence: Synthetic polynucleotide
atgtcatatttcgataactacttcaatgagatagttaattccgtgaacgacatcattaagtcttacatctctggcgacgtaccaaaactatacgaagcctcctaccatttgtttacatcaggaggaaagagactaagaccattgatccttacaatttcttctgatcttttcggtggacagagagaaagagcatactatgctggcgcagcaatcgaagttttgcacacattcactttggttcacgatgatatcatggatcaagataacattcgtagaggtcttcctactgtacatgtcaagtatggcctacctttggccattttagctggtgacttattgcatgcaaaagcctttcaattgttgactcaggcattgagaggtctaccatctgaaactatcatcaaggcgtttgatatctttacaagatctatcattatcatatcagaaggtcaagctgtcgatatggaattcgaagatagaattgatatcaaggaacaagagtatttggatatgatatctcgtaaaaccgctgccttattctcagcttcttcttccattggggcgttgatagctggagctaatgataacgatgtgagattaatgtccgatttcggtacaaatcttgggatcgcatttcaaattgtagatgatatacttggtttaacagctgatgaaaaagagctaggaaaacctgttttcagtgatatcagagaaggtaaaaagaccatattagtcattaagactttagaattgtgtaaggaagacgagaaaaagattgtgttaaaagcgctaggcaacaagtcagcatcaaaggaagagttgatgagttctgctgacataatcaaaaagtactcattggattacgcctacaacttagctgagaaatactacaaaaacgccatcgattctctaaatcaagtttcaagtaaaagtgatattccagggaaggcattgaaatatcttgctgaattcaccatcagaagacgtaagtaa

SEQ ID NO: 24 - DNA, 894 bp, Artificial Sequence
  Description of Artificial Sequence: Synthetic polynucleotide
atggtcgcacaaactttcaacctggatacctacttatcccaaagacaacaacaagttgaagaggccctaagtgctgctcttgtgccagcttatcctgagagaatatacgaagctatgagatactccctcctggcaggtggcaaaagattaagacctatcttatgtttagctgcttgcgaattggcaggtggttctgttgaacaagccatgccaactgcgtgtgcacttgaaatgatccatacaatgtcactaattcatgatgacctgccagccatggataacgatgatttcagaagaggaaagccaactaatcacaaggtgttcggggaagatatagccatcttagcgggtgatgcgcttttagcttacgcttttgaacatattgcttctcaaacaagaggagtaccacctcaattggtgctacaagttattgctagaatcggacacgccgttgctgcaacaggcctcgttggaggccaagtcgtagaccttgaatctgaaggtaaagctatttccttagaaacattggagtatattcactcacataagactggagccttgctggaagcatcagttgtctcaggcggtattctcgcaggggcagatgaagagcttttggccagattgtctcattacgctagagatataggcttggcttttcaaatcgtcgatgatatcctggatgttactgctacatctgaacagttggggaaaaccgctggtaaagaccaggcagccgcaaaggcaacttatccaagtctattgggtttagaagcctctagacagaaagcggaagagttgattcaatctgctaaggaagccttaagaccttacggttcacaagcagagccactcctagcgctggcagacttcatcacacgtcgtcagcattaa

SEQ ID NO: 25 - DNA, 1116 bp, Artificial Sequence
  Description of Artificial Sequence: Synthetic polynucleotide
atggcctctgttactttgggttcctggatcgtcgtccaccaccataaccatcaccatccatcatctatcctaactaaatctcgttcaagatcctgtcctattacactaaccaaaccaatctcttttcgttcaaagagaacagtttcctctagtagttctatcgtgtcctctagtgtcgtcactaaggaagacaatctgagacagtctgaaccttcttcctttgatttcatgtcatatatcattactaaggcagaactagtgaataaggctcttgattcagcagttccattaagagagccattgaaaatccatgaagcaatgagatactctcttctagctggcgggaagagagtcagacctgtactctgcatagcagcgtgcgaattagttggtggcgaggaatcaaccgctatgcctgccgcttgtgctgtagaaatgattcatacaatgtcactgatacacgatgatttgccatgtatggataacgatgatctgagaaggggtaagccaactaaccataaggttttcggcgaagatgttgccgtcttagctggtgatgctttgttatctttcgcgttcgaacatttggcatccgcaacatcaagtgatgttgtgtcaccagtaagagtagttagagcagttggagaactggctaaagctattggaactgagggtttagttgcaggtcaagtcgtcgatatctcttccgaaggtcttgatttgaatgatgtaggtcttgaacatctcgaattcatccatcttcacaagacagctgcacttttagaagccagtgcggttctcggcgcaattgttggcggagggagtgatgacgaaattgagagattgaggaagtttgctagatgtataggattactgttccaagtagtagacgatatactagatgtgacaaagtcttccaaagagttgggaaaaacagctggtaaagatttgattgccgacaaattgacctaccctaagattatggggctagaaaaatcaagagaatttgccgagaaactcaatagagaggcgcgtgatcaactgttgggtttcgattctgataaagttgcaccactcttagccttagccaactacatcgcttacagacaaaactaa

SEQ ID NO: 26 - DNA, 1086 bp, Stevia rebaudiana
atggctcttgtaaatcccacagctttgttctatggaacctccataagaaccagacccacaaacttgctcaacccgacccaaaaacttcgacccgtttcctcgtcttctttgccttccttctcttcagtttctgcaatcttgacggaaaaacaccaatcaaacccatcagaaaacaataacttgcaaacccatctcgaaacaccattcaatttcgactcttacatgctggagaaagtaaacatggtgaatgaagctctggacgcctcggttccactcaaagacccgataaagatccatgaatccatgcggtactcccttctagctggcgggaaacgcatccgaccgatgatgtgcatcgccgcttgcgaaatagtcggaggcaacatattaaacgccatgccagctgcatgcgcggtcgagatgattcacaccatgtcactagttcatgacgaccttccatgcatggataacgacgacttccgacgtggaaaaccaataagccacaaggtgtacggtgaagaaatggcggttctaaccggggacgcgttactctcattatccttcgaacatatcgcgaccgcgacaaaaggcgtatccaaagacaggatcgtccgagccattggtgaactcgcaaggtccgttggctcggagggtttggtcgccggtcaggtggttgatattttatccgaaggggctgatgttgggttagaccacttggagtatattcatatacacaagactgcaatgttgcttgagagctcggtcgtgatcggcgcgatcatgggcggtgggtctgaccaacagatcgaaaagttgcgaaagtttgcgagatcgattggtttgttgtttcaggtggtagatgatattcttgatgtcacaaagtcgactgaggaattggggaaaacggcgggaaaagatttgctgacggacaagacaacgtatccgaagttgttggggatcgaaaaatcgagagaatttgcggagaaattaaacaaggaagcgcaagaacaattgtcggggtttgatcgccgcaaggcggctccgttaattgcccttgctaattacaatgcttataggcaaaactga

SEQ ID NO: 27 - DNA, 1029 bp, Gibberella fujikuroi
atggctgaacaacagatctccaaccttctttcaatgtttgatgcttctcacgcaagccagaagttggagattacggttcagatgatggatacctaccattacagagaaactcctccagactcttcctcttcagaaggcggttccttatctcgctatgatgagcgacgggtctcccttccgctctctcacaatgcagcctccccagacatagtctcccagttatgcttctcaacagctatgagctcggagctcaatcacaggtggaagtcacagcgcctcaaggttgctgactctccctacaactacatcctgactcttccatctaaaggtattcgtggggctttcattgactcactgaatgtctggctcgaggtccccgaagacgagacctcggtgatcaaagaggtgattggcatgctccacaactcgtctctcataatcgatgacttccaagacaactccccacttcggcggggcaagccatctacacatactgtcttcggtccagcacaagcaatcaacacagcaacatatgtcatcgtcaaggccatcgagaaaatacaggatatcgtcggtcacgatgcattggcagatgtaactggcactataaccacaatcttccagggtcaggcaatggatctgtggtggactgctaatgccattgttccgtctatccaagaatatctcctgatggtcaatgacaagactggtgccctgttcaggttatcgcttgaactactggcgctgaactctgaagcatccatcagtgacagcgcgcttgaatctctcagcagcgctgtctcactgctcgggcagtatttccagataagagatgattacatgaatctcattgacaacaagtatactgatcagaaaggattttgcgaggatctggacgaggggaaatactcgttgactctaatccatgctctgcagaccgactccagcgaccttctcaccaacatcttatcgatgagaagagtccaaggaaaacttacggcgcagaaaagatgctggttttggaagtga

SEQ ID NO: 28 - DNA, 903 bp, Mus musculus
atggagaaaactaaagagaaagctgagaggattcttctagagccctataggtacttacttcagttaccaggtaaacaggtgagaagcaaactttcacaggcatttaatcactggctgaaagttccagaagacaagctacagattatcattgaagtgactgaaatgttgcataatgccagtttactcattgatgatattgaagacagttcaaagctccgacgtggtttcccagtggctcacagcatctatggtgtcccatctgtcattaattctgccaattacgtctacttccttggactggaaaaagtcttaacccttgatcacccggatgcggtgaagcttttcacacgccagcttctggaacttcatcagggacaaggcctcgatatttactggagggacacctacacttgtccaactgaagaagaatataaagccatggtgttgcagaagacaggtggtttgtttggattagcagtaggtcttatgcagctgttctctgattacaaagaagatctaaagccactgcttgacacacttgggctctttttccagattagagatgattatgccaatctacactccaaagaatacagtgaaaacaaaagtttctgtgaagacttgacagaagggaagttctcattccccactatccatgccatttggtcaaggccagaaagcacccaggtacagaacatcctgcgccagagaacagagaatatagatattaaaaagtattgtgtgcagtacctggaggatgtaggttcttttgcatacactcgacacactcttagagagcttgaagctaaagcctacaaacaaattgaggcctgtggtgggaacccttcactagtggctttagtcaagcacttaagtaagatgttcacagaagaaaataaataa

SEQ ID NO: 29 - DNA, 1020 bp, Thalassiosira pseudonana
atggctcgtttctacttcctgaacgctctcctcatggtgatttctttacaaagcaccacggcattcaccccggcaaaactcgcctacccaacaaccaccactgcattaaacgttgcctctgccgaaacatcatttagcctcgatgaatacctagcctccaaaatcggacccattgaatcagctctcgaggcatctgtcaaatctcgcattcctcaaactgacaagatatgcgagtctatggcatactcactcatggctggaggaaagcgtatccgtcccgttttgtgcattgctgcttgtgaaatgtttgggggaagtcaagatgtggctatgccgacggctgtggctttggagatgattcatactatgagtcttattcatgacgatttgccttcaatggacaacgatgatctccgacgaggaaagccaactaatcatgttgtctttggagaggatgttgctattcttgctggggattctcttctcagtacgtcttttgaacatgttgcccgtgaaaccaaaggagtgtcagctgaaaagattgtagatgttatcgctcgcctcgggaagtctgtgggtgcagagggtcttgctggtggacaggttatggatcttgagtgtgaggcgaagccaggaactaccctcgacgatctcaagtggattcacattcacaaaactgccactcttcttcaagtggcagtggcatcaggtgctgttcttggaggggccacaccagaggaggttgctgcttgtgaactgttcgcaatgaatattggacttgccttccaggtcgctgatgatattttggacgtgacggcatcgagtgaggatcttggcaaaactgctggaaaggatgaagccacagataagacaacttatcctaagcttttgggattggaggagagtaaggcatacgctcgacaactcatagacgaagcaaaggaatctttggctcctttcggtgatcgtgctgctccattgttggcaattgccgactttatcattgatcgaaagaactag

SEQ ID NO: 30 - DNA, 1068 bp, Streptomyces clavuligerus
atgcacctggctccccgccgagtaccgcgcggccgtcgaagcccacctgaccgcgttcctgaacgccaaggagcgctcggccgccgccggggggccggttccacaggatgtgcccgcgctgctgcgggagttcatcggcgccggggggggggggaagcggatccgtccgctgctgtgcatcgcggctggcaggccggcggcggaacaggactgccggacgaggtggtgtccacagcggcggcgctggagatgttccacgcgttcgcgctgatccacgacgacatcatggatgactccgcgaccaggcgcggcagcccgacggtgcaccgggcactcgccgaccggctcggcgccgctctcgaccccgaccaagccggacaactgggggtgagcacggcgatcctcgtcggggacctcgccctgacctggtcggacgaactgctgtacgctcccctgaccccccaccggctggccgcggtactgcccctggtcacggccatgcgcgcggaaacggtccacggccagtacctggacatcacctccgcccgccggcccggcacggacacctcactggcgctgcgaatcgcgcgctacaaaaccgctgcttacaccatggaacgccccctgcacatcggagcagcgctcgccggcgcacgaccggaactcctggcagggctcagcgcctacgcgctgccggcgggcgaggcattccagctcgccgacgacctcctgggagtgttcggcgatccacggagaaccggcaaacccgacctcgacgacctccgcggcggcaagcacaccgtcctcgtggccctcgcccgggaacacgccacacctgaacagcggcacaccctggacaccctgctcggcacaccaggcctcgaccggcagggcgcgtcccggctgcgctgcgtcctcgtcgccaccggggcccgggcggaagccgaacgcctgatcaccgaacggcgcgaccaggccctcaccgcgctcaacgccctgacactgcccccaccgctcgccgaggcactcgcccgcctcaccctcgggagtaccgcacacccggcctga

SEQ ID NO: 31 - DNA, 993 bp, Sulfulobus acidicaldarius
atgagttactttgacaactattttaatgagattgttaattctgtaaacgacattattaagagctatatatctggagatgttcctaaactatatgaagcctcatatcatttgtttacatctggaggtaagaggttaagaccattaatcttaactatatcatcagatttattcggaggacagagagaaagagcttattatgcaggtgcagctattgaagttcttcatacttttacgcttgtgcatgatgatattatggatcaagataatatcagaagagggttacccacagtccacgtgaaatacggcttacccttagcaatattagctggggatttactacatgcaaaggcttttcagctcttaacccaggctcttagaggtttgccaagtgaaaccataattaaggctttcgatattttcactcgttcaataataattatatccgaaggacaggcagtagatatggaatttgaggacagaattgatataaaggagcaggaataccttgacatgatctcacgtaagacagctgcattattctcggcatcctcaagtataggcgcacttattgctggtgctaatgataatgatgtaagactgatgtctgatttcggtacgaatctaggtattgcatttcagattgttgacgatatcttaggtctaacagcagacgaaaaggaacttggaaagcctgtttttagtgatattagggagggtaaaaagactatacttgtaataaaaacactggagctttgtaaagaggacgagaagaagattgtcctaaaggcgttaggtaataagtcagcctcaaaagaagaattaatgagctcagcagatataattaagaaatactctttagattatgcatacaatttagcagagaaatattataaaaatgctatagactctttaaatcaagtctcctctaagagtgatatacctggaaaggctttaaaatatctagctgaatttacgataagaaggagaaaataa

SEQ ID NO: 32 - DNA, 894 bp, Synechococcus sp.
ttggttgcccaaaccttcaacctggacacctacttgagccaacgccagcaacaggtggaagaggcgctttctgcggcattggttcccgcctatccggagcgcatttacgaggcgatgcgctacagcctgctggcgggggggaaacgcctgaggccgatcctctgtctggcggcctgtgagttggccggcggctctgtggagcaggccatgcccaccgcctgcgccctggagatgatccacaccatgtcgctgatccacgacgatctgccggcgatggacaacgacgattttcgccgcggcaagcccaccaatcacaaggtattcggcgaggatatcgccattttggcaggagatgccctgttggcctatgcctttgagcatatcgccagccaaacgcggggggtgccgccgcagttggtgctgcaagtcattgcccgcattggccatgctgtggcggcaaccggcttggtagggggccaggtggtggatctggagtccgaaggcaaagccatttccctagaaactttggagtacatccacagtcacaagacgggtgctctgctggaggcctcggtggtttcgggagggatcctggcaggggccgatgaggagctgctggcgcggctgagccactacgctcgggacatcggcctggcttttcagatcgtggacgacattttggatgttactgccaccagcgagcaactgggcaaaacggcaggcaaggatcaagctgccgccaaagccacctaccccagcttgttgggcctagaggcttcccggcagaaagctgaggaactgatccaatcggccaaggaggcgttgcgcccctacggatcccaggccgagcccctgttggctctggccgatttcatcacccgccgccagcattga

SEQ ID NO: 33 - DNA, 1116 bp, Arabidopsis thaliana
atggcttcagtgactctaggttcatggattgttgttcaccaccacaatcatcatcatccatcttcaatccttaccaaatccagatccagatcttgtcctataactcttactaaacccatctcctttcgatcaaaacgcaccgtttcatcatcttcttcaatcgtttcttcttccgttgttacaaaagaagacaatctacgccaatctgaaccatcctctttcgatttcatgtcgtacatcatcaccaaagccgaattagtcaacaaagctttagattcagctgttcctctccgtgagccactcaagatccacgaagcgatgcgttactctcttctcgccggtggcaaaagagttagaccagttctctgcatcgctgcttgtgaactcgtcggaggtgaagaatcaaccgctatgccagcagcttgcgccgtcgagatgattcacaccatgtcgttgatccacgacgatctcccttgtatggataacgacgatctccgccgtggaaaaccgaccaaccacaaagtgtttggtgaagacgtcgctgttttagccggagacgcgcttctctctttcgctttcgagcatttagcttcggcgacgagttctgatgttgtttctccggtgagagtggttcgagccgttggagaattggctaaagcgataggaacagaagggttagtggcgggtcaagtcgtggatattagtagtgaagggttagatttaaacgacgtcggtttagagcatttggagtttatccatttgcataaaacggcggcgttgcttgaagcttctgctgttttgggagctattgttggtggaggaagtgatgatgagattgagaggttaagaaagtttgcgagatgtattggtttgttgtttcaggtggttgatgatatcttggatgtgacgaaatcgtcgaaagagttagggaaaactgctgggaaagatttgattgctgataagttgacgtatcctaagattatgggtttggagaaatcgagagagtttgctgagaaattgaatagagaggctcgtgatcagcttttagggtttgattctgataaggttgctcctttgttggctttggctaattacattgcctatagacagaactga

SEQ ID NO: 34 - DNA, 2364 bp, Artificial Sequence
  Description of Artificial Sequence: Synthetic polynucleotide
atgaaaaccgggtttatctcaccagcaacagtatttcatcacagaatctcaccagcgaccactttcagacatcacttatcacctgctactacaaactctacaggcattgtcgccttaagagacatcaacttcagatgtaaagcagtttctaaagagtactctgatctgttgcagaaagatgaggcttctttcacaaaatgggacgatgacaaggtgaaagatcatcttgataccaacaaaaacttatacccaaatgatgagattaaggaatttgttgaatcagtaaaggctatgttcggtagtatgaatgacggggagataaacgtctctgcatacgatactgcatgggttgctttggttcaagatgtcgatggatcaggtagtcctcagttcccttcttctttagaatggattgccaacaatcaattgtcagatggatcatggggagatcatttgctgttctcagctcacgatagaatcatcaacacattagcatgcgttattgcacttacaagttggaatgttcatccttctaagtgtgaaaaaggtttgaattttctgagagaaaacatttgcaaattagaagatgaaaacgcagaacatatgccaattggttttgaagtaacattcccatcactaattgatatcgcgaaaaagttgaacattgaagtacctgaggatactccagcacttaaagagatctacgcacgtagagatatcaagttaactaagatcccaatggaagttcttcacaaggtacctactactttgttacattctttggaaggaatgcctgatttggagtgggaaaaactgttaaagctacaatgtaaagatggtagtttcttgttttccccatctagtaccgcattcgccctaatgcaaacaaaagatgagaaatgcttacagtatctaacaaatatcgtcactaagttcaacggtggcgtgcctaatgtgtacccagtcgatttgtttgaacatatttgggttgttgatagactgcagagattggggattgccagatacttcaaatcagagataaaagattgtgtagagtatatcaataagtactggaccaaaaatggaatttgttgggctagaaatactcacgttcaagatatcgatgatacagccatgggattcagagtgttgagagcgcacggttatgacgtcactccagatgtttttagacaatttgaaaaagatggtaaattcgtttgctttgcagggcaatcaacacaagccgtgacaggaatgtttaacgtttacagagcctctcaaatgttgttcccaggggagagaattttggaagatgccaaaaagttctcttacaattacttaaaggaaaagcaaagtaccaacgaattgctggataaatggataatcgctaaagatctacctggtgaagttggttatgctctggatatcccatggtatgcttccttaccaagattggaaactcgttattaccttgaacaatacggcggtgaagatgatgtctggataggcaagacattatacagaatgggttacgtgtccaataacacatatctagaaatggcaaagctggattacaataactatgttgcagtccttcaattagaatggtacacaatacaacaatggtacgtcgatattggtatagagaagttcgaatctgacaacatcaagtcagtcctggtttcttactacttggctgcggcttcaatattcgaacctgagagatctaaggagagaatcgcttgggcaaagacaacaatcttagtcgataagatcacatcaattttcgattcctctcagtcaagtaaggaagatattactgcctttattgacaagtttcgtaacaagtcctcctctaaaaagcactctatcaacggtgaaccatggcatgaagttatggtagctttgaaaaagaccttacacggctttgctctggatgctcttatgactcattctcaagatatacatccacagttacatcaagcctgggaaatgtggttgactaaactacaagacggcgtagatgttactgctgagctaatggtccaaatgatcaacatgactgctggcagatgggtatcaaaggaattacttactcatccacaatatcaaagattgtctactgtgacaaattctgtgtgtcacgatattaccaaacttcacaatttcaaggagaattccaccacagtggattcaaaggttcaggaactagtccagttggtttttagtgacacaccagatgatttggatcaagatatgaaacaaacattcctgacagtgatgaagacattctactacaaggcgtggtgtgatccaaacactataaacgatcatatatctaaagttttcgaaatcgtaatttga

SEQ ID NO: 35 - DNA, 1584 bp, Artificial Sequence
  Description of Artificial Sequence: Synthetic polynucleotide
atgcctgatgcacacgatgctccacctccacaaataagacagagaacactagtagatgaggctacccaactgctaactgagtccgcagaagatgcatggggtgaagtcagtgtgtcagaatacgaaacagcaaggctagttgcccatgctacatggttaggtggacacgccacaagagtggccttccttctggagagacaacacgaagacgggtcatggggtccaccaggtggatataggttagtccctacattatctgctgttcacgcattattgacatgtcttgcctctcctgctcaggatcatggcgttccacatgatagacttttaagagctgttgacgcaggcttgactgccttgagaagattggggacatctgactccccacctgatactatagcagttgagctggttatcccatctttgctagagggcattcaacacttactggaccctgctcatcctcatagtagaccagccttctctcaacatagaggctctcttgtttgtcctggtggactagatgggagaactctaggagctttgagatcacacgccgcagcaggtacaccagtaccaggaaaagtctggcacgcttccgagactttgggcttgagtaccgaagctgcttctcacttgcaaccagcccaaggtataatcggtggctctgctgctgccacagcaacatggctaaccagggttgcaccatctcaacagtcagattctgccagaagataccttgaggaattacaacacagatactctggcccagttccttccattacccctatcacatacttcgaaagagcatggttattgaacaattttgcagcagccggtgttccttgtgaggctccagctgctttgttggattccttagaagcagcacttacaccacaaggtgctcctgctggagcaggattgcctccagatgctgatgatacagccgctgtgttgcttgcattggcaacacatgggagaggtagaagaccagaagtactgatggattacaggactgacgggtatttccaatgctttattggggaaaggactccatcaatttcaacaaacgctcacgtattggaaacattagggcatcatgtggcccaacatccacaagatagagccagatacggatcagccatggataccgcatcagcttggctgctggcagctcaaaagcaagatggctcttggttagataaatggcatgcctcaccatactacgctactgtttgttgcacacaagccctagccgctcatgcaagtcctgcaactgcaccagctagacagagagctgtcagatgggttttagccacacaaagatccgatggcggttggggtctatggcattcaactgttgaagagactgcttatgccttacagatcttggccccaccttctggtggtggcaatatcccagtccaacaagcacttactagaggcagagcaagattgtgtggagccttgccactgactcctttatggcatgataaggatttgtatactccagtaagagtagtcagagctgccagagctgctgctctgtacactaccagagatctattgttaccaccattgtaa

SEQ ID NO: 36 - DNA, 1551 bp, Artificial Sequence
  Description of Artificial Sequence: Synthetic polynucleotide
atgaacgccctatccgaacacattttgtctgaattgagaagattattgtctgaaatgagtgatggcggatctgttggtccatctgtgtatgatacggcccaggccctaagattccacggtaacgtaacaggtagacaagatgcatatgcttggttgatcgcccagcaacaagcagatggaggttggggctctgccgactttccactctttagacatgctccaacatgggctgcacttctcgcattacaaagagctgatccacttcctggcgcagcagacgcagttcagaccgcaacaagattcttgcaaagacaaccagatccatacgctcatgccgttcctgaggatgcccctattggtgctgaactgatcttgcctcagttttgtggagaggctgcttggttgttgggaggtgtggccttccctagacacccagccctattaccattaagacaggcttgtttagtcaaactgggtgcagtcgccatgttgccttcaggacacccattgctccactcctgggaggcatggggtacttctccaacaacagcctgtccagacgatgatggttctataggtatctcaccagcagctacagccgcctggagagcccaggctgtgaccagaggctcaactcctcaagtgggcagagctgacgcatacttacaaatggcttcaagagcaacgagatcaggcatagaaggagtcttccctaatgtttggcctataaacgtattcgaaccatgctggtcactgtacactctccatcttgccggtctgttcgcccatccagcactggctgaggctgtaagagttatcgttgctcaacttgaagcaagattgggagtgcatggcctcggaccagctttacattttgctgccgacgctgatgatactgcagttgccttatgcgttctgcatttggctggcagagatcctgcagttgacgcattgagacattttgaaattggtgagctctttgttacattcccaggagagagaaatgctagtgtctctacgaacattcacgctcttcatgctttgagattgttaggtaaaccagctgccggagcaagtgcatacgtcgaagcaaatagaaatccacatggtttgtgggacaacgaaaaatggcacgtttcatggctttatccaactgcacacgccgttgcagctctagctcaaggcaagcctcaatggagagatgaaagagcactagccgctctactacaagctcaaagagatgatggtggttggggagctggtagaggatccactttcgaggaaaccgcctacgctcttttcgctttacacgttatggacggatctgaggaagccacaggcagaagaagaatcgctcaagtcgtcgcaagagccttagaatggatgctagctagacatgccgcacatggattaccacaaacaccactctggattggtaaggaattgtactgtcctactagagtcgtaagagtagctgagctagctggcctgtggttagcattaagatggggtagaagagtattagctgaaggtgctggtgctgcaccttaa

SEQ ID NO: 37 - DNA, 2364 bp, Stevia rebaudiana
atgaagaccggcttcatctctcccgccaccgtcttccaccaccgtatttctccggcaaccaccttccgccaccacctttctccggcgaccaccaactccactggaattgtagctcttagagacatcaacttccggtgtaaagcggtatccaaagagtactctgatttactacaaaaagatgaggcttcatttaccaagtgggacgatgacaaagtgaaggaccatttggacacaaataagaatttgtatccaaacgatgagatcaaggagtttgttgagagcgtgaaagcaatgtttggttctatgaatgacggagaaataaatgtgtcagcgtatgatacggcttgggttgcactcgtgcaagatgttgatggaagtggttcccctcaatttccatcaagtttggagtggatcgcgaacaatcaactctcagatgggtcttggggcgatcatttgttattttcggctcatgataggatcattaacacgttggcatgtgttatagcgcttacttcttggaacgtccatccaagtaaatgtgaaaaaggactgaattttcttagagaaaacatatgtaaactcgaagacgagaacgcggaacatatgccaattggttttgaagtcacgttcccgtcgctaatagatatcgcaaagaagctaaatattgaagttcctgaggatactcctgccttaaaagaaatttatgcaagaagagacataaaactcacaaagataccaatggaagtattgcacaaagtgcccacaactttacttcatagtttggaaggaatgccagatttggaatgggaaaaacttctgaaattgcaatgcaaagatggatcatttctgttttctccatcatctactgcttttgcactcatgcaaacaaaagatgaaaagtgtcttcagtatttgacaaatattgttaccaaattcaatggtggagttccgaatgtgtacccggtggatctattcgaacatatttgggtagttgatcgacttcaacgacttgggattgctcgttatttcaaatcagagatcaaagattgcgttgaatatattaacaagtattggacaaagaatgggatttgttgggcaagaaacacgcacgtacaagatattgatgataccgcaatgggatttagggttttaagagcacatggttatgatgttactccagatgtatttcgacaatttgagaaggatggtaaattcgtatgtttcgctggacagtcaacacaagccgtcaccggaatgttcaatgtgtatagagcgtcacaaatgctctttcccggagaaagaattcttgaagatgcaaagaaattttcatataattatttgaaagaaaaacaatcgacaaatgagcttcttgataaatggatcatcgccaaagacttacctggagaggttggatatgcgctagacataccatggtatgcaagcttaccgcgactcgagacaagatattacttagagcaatacgggggcgaggatgatgtttggattggaaaaactctatacaggatgggatatgtgagcaataatacgtaccttgaaatggccaaattggactacaataactatgtggccgtgcttcaactcgaatggtacactatccagcaatggtatgttgatatcggtatcgaaaagtttgaaagtgacaatatcaaaagcgtattagtgtcgtattacttggctgcagccagcatattcgagccggaaaggtccaaggaacgaatcgcgtgggctaaaaccaccatattagttgacaagatcacctcaatttttgattcatcacaatcctcaaaagaggacataacagcctttatagacaaatttaggaacaaatcgtcttctaagaagcattcaataaatggagaaccatggcacgaggtgatggttgcactgaaaaagaccctacacggcttcgctttggatgcactcatgactcatagtcaagacatccacccgcaactccatcaagcttgggagatgtggttgacgaaattgcaagatggagtagatgtgacagcggaattaatggtacaaatgataaatatgacagctggtcgttgggtatccaaagaacttttaactcatcctcaataccaacgcctctcaaccgtcacaaatagtgtgtgtcacgatataactaagctccataacttcaaggagaattccacgacggtagactcgaaagttcaagaactagtgcaacttgtgtttagcgacacgcccgatgatcttgatcaggatatgaaacagacgtttctaaccgtcatgaaaaccttctactacaaggcgtggtgtgatccgaacacgataaatgaccatatctccaaggtgttcgagattgtaatatga

SEQ ID NO: 38 - DNA, 1584 bp, Streptomyces clavuligerus
ttgcccgacgcgcatgatgcccctccgcctcagatacgacagcggacccttgtcgatgaggcgacgcaactcctcacggagtcggccgaggacgcctggggtgaggtgtccgtgtccgagtacgaaacggcgcggctggtggcccacgccacctggctcggcggtcacgccacacgggtggccttcctgctggagcggcagcatgaggacggctcgtggggcccgcccggcgggtaccgtctcgtacccacgctgagtgccgtacacgccctgctcacctgtctggcgtctcccgcgcaggaccacggagtgcctcatgaccggctcctgcgcgcagttgacgcgggcctgacggcactgcgtcgtcttgggacgagcgacagcccgccggacaccattgcggtcgaactggtcataccctcgctccttgagggcatccagcacctcctggacccggcgcacccgcattcccgacccgctttttcgcaacaccgcggcagcctcgtctgccccgggggcctcgacggccgcacgctgggggccttgcgctcccacgccgcagccggcacacctgtcccgggcaaggtgtggcacgcctcggaaaccttggggctatcgaccgaggcagcctcccaccttcaacccgcccagggcatcatcggtggctccgccgccgcgacagcaacatggctcaccagggtcgccccgtcgcaacagagcgacagcgcacggcgctacctggaagaactccagcaccgatacagcggcccggtgccctccatcaccccgatcacctatttcgaacgggcctggctgctcaacaacttcgctgccgcgggggttccatgcgaggctccggcagcccttctcgacagcctggaggcagcgctcacaccacagggcgctccagcgggtgcgggactgccgccggacgcggatgacaccgccgccgttctgctggcgcttgccacgcacggccgcgggcgccgtcccgaggtcctcatggactaccgcacggacggctacttccagtgcttcatcggcgaacgcaccccttccatcagcaccaatgcccatgtcctggagacgctcggtcaccacgtcgcccaacaccctcaggacagggcccgatacggctcagccatggacaccgcatcagcgtggctcctcgcggctcagaagcaggatggcagctggctcgacaagtggcacgcctccccctactacgccaccgtctgctgcacccaggcactggcagcccacgcttcccctgccaccgcccccgcacggcagcgtgctgtgcggtgggtgctggcaacacaacgctcggacggcggctggggcctgtggcactccacggtcgaggagaccgcctacgccctgcagatcctcgccccaccttccggcggcgggaacatccccgtgcaacaggcgctcaccagggggcgcgcccgcctctgcggcgctttgccgctgactcccctatggcatgacaaggacctgtacacgccggtacgtgtcgtccgcgccgcccgtgccgccgccctgtacaccacccgtgacctgcttctgccgcccctgtga

SEQ ID NO: 39 - DNA, 1551 bp, Bradyrhizobium japonicum
gtgaacgcgctgtccgaacatatcctttccgaattgcgccgcctgctgagcgaaatgagcgatggcggcagcgtcggtccgtccgtctacgacacggcgcaggcgctgcgcttccacggcaacgtcaccggtcggcaggacgcatacgcgtggctcatcgcgcagcaacaggccgacggcggatggggaagcgcggacttcccgctgttccgccatgcgcccacgtgggcggcgttactggcattgcagcgtgccgatcctcttcccggagctgcggacgcagtccagactgcaacgaggttcctccagcgccagcccgatccctacgcacatgcggtgccagaagacgcgccgatcggcgcggagctgatcctgccgcagttttgcggtgaggccgcatggttgctgggtggcgtagcgtttccgcgccatcctgcgctgttgccattgcggcaagcgtgcctggtcaagctgggggcggtggcgatgttgccgagcggccatccgttgctacactcctgggaagcctgggggacgtcgccgaccaccgcatgcccggatgacgacggcagcatcggcatcagtccggcggccaccgccgcgtggcgtgcccaggccgtgacacgggggagcacgccgcaggtcgggcgcgccgatgcgtatctgcagatggcatcgcgggcgacgcgcagcggcatcgaaggtgtctttcccaacgtctggccgatcaatgtgttcgagccatgctggtcgctgtacaccctgcatctggccgggcttttcgcgcatcccgcgctcgcggaggcggttcgcgtgatcgtcgcgcagctcgaggcccgtctgggcgtgcacggtctgggcccggccttgcacttcgcggctgatgcggacgacaccgccgttgcgttgtgcgtcctgcaccttgcaggccgtgacccggcggtcgatgcgttgcgccatttcgaaatcggcgagctgttcgtcaccttccccggcgaacgcaatgcctcggtgtcgaccaacattcatgccctgcatgcgttgcgactgttgggaaagcccgccgcgggcgccagcgcgtacgtcgaggccaatcgcaacccgcacggtctatgggacaacgaaaaatggcacgtttcgtggctgtatcccaccgcgcatgcggtcgctgcgctggcgcaaggcaagccccagtggcgagatgagcgcgcgctggcggcgctgctgcaggcgcagcgcgacgacggtggctggggcgcgggtcgcgggtccacgttcgaggaaaccgcctatgcgctgtttgcgttgcacgtgatggatgggagcgaagaggcgacagggcgccggcgcatcgcgcaggtggtggcgcgtgcgctggagtggatgctcgcccgccatgcggcgcatggattgccgcagacgccgctgtggatcggcaaggaactgtattgccccactcgggtcgtgcgcgtggccgaactcgccgggttgtggctggcgcttcgttgggggcggcgcgtcctggccgagggggcaggagcggcgccatga

SEQ ID NO: 40 - DNA, 2355 bp, Artificial Sequence
  Description of Artificial Sequence: Synthetic polynucleotide
atgaatttgagtttgtgtatagcatctccactattgaccaaatctaatagaccagctgctttatcagcaattcatacagctagtacatcccatggtggccaaaccaaccctacgaatctgataatcgatacgaccaaggagagaatacaaaaacaattcaaaaatgttgaaatttcagtttcttcttatgatactgcgtgggttgccatggttccatcacctaattctccaaagtctccatgtttcccagaatgtttgaattggctgattaacaaccagttgaatgatggatcttggggtttagtcaatcacacgcacaatcacaaccatccacttttgaaagattctttatcctcaactttggcttgcatcgtggccctaaagagatggaacgtaggtgaggatcagattaacaaggggcttagtttcattgaatctaacttggcttccgcgactgaaaaatctcaaccatctccaataggattcgatatcatctttccaggtctgttagagtacgccaaaaatctagatatcaacttactgtctaagcaaactgatttctcactaatgttacacaagagagaattagaacaaaagagatgtcattcaaacgaaatggatggttacctagcttatatctctgaaggtcttggtaatctttacgattggaatatggtgaaaaagtaccagatgaaaaatggctcagttttcaattccccttctgcaactgcggcagcattcattaaccatcaaaatccaggatgcctgaactatttgaattcactactagacaaattcggcaacgcagttccaactgtataccctcacgatttgtttatcagattgagtatggtggatacaattgaaagacttggtatatcccaccactttagagtcgagatcaaaaatgttttggatgagacataccgttgttgggtggagagagatgaacaaatctttatggatgttgtgacgtgcgcgttggcctttagattgttgcgtattaacggttacgaagttagtccagatccacttgccgaaattacaaacgaattagctttaaaggatgaatacgccgctcttgaaacatatcatgcgtcacatatcctttaccaagaggacttatcatctggaaaacaaattcttaaatctgctgatttcctgaaggaaatcatatccactgatagtaatagactgtccaaactgatccataaagaggttgaaaatgcacttaagttccctattaacaccggcttagaacgtattaacacaagacgtaacatccagctttacaacgtagacaatactagaatcttgaaaaccacttaccattcttccaacatatcaaacactgattacctaagattagctgttgaagatttctacacatgtcagtctatctatagagaagagctgaaaggattagagagatgggtcgttgagaataagctagatcaattgaaatttgccagacaaaagacagcttattgttacttctcagttgccgccactttatcaagtccagaattgtcagatgcacgtatttcttgggctaaaaacggaattttgacaactgttgttgatgatttctttgatattggcgggacaatcgacgaattgacaaacctgattcaatgcgttgaaaagtggaatgtcgatgtcgataaagactgttgctcagaacatgttagaatactgttcttggctctgaaagatgctatctgttggatcggggatgaggctttcaaatggcaagctagagatgtgacgtctcacgtcattcaaacctggctagaactgatgaactctatgttgagagaagcaatttggactagagatgcatacgttcctacattaaacgagtatatggaaaacgcttatgtctcctttgctttgggtcctatcgttaagcctgccatatactttgtaggaccaaagctatccgaggaaatcgtcgaatcatcagaataccataacttgttcaagttaatgtccacacaaggcagattacttaatgatattcattctttcaaaagagagtttaaggaaggaaagttaaatgctgttgctctgcatctttctaatggcgaaagtggtaaagtcgaagaggaagtagttgaggaaatgatgatgatgatcaaaaacaagagaaaggagttgatgaaactaatcttcgaagagaacggttcaattgttcctagagcatgtaaggatgcattttggaacatgtgtcatgtgctaaactttttctacgcaaacgacgatggttttactgggaacacaatactagatacagtaaaagacatcatatacaaccctttggtcttagtaaacgaaaacgaggagcaaagataa

SEQ ID NO: 41 - DNA, 2355 bp, Artificial Sequence
  Description of Artificial Sequence: Synthetic polynucleotide
atgaatctgtccctttgtatagctagtccactgttgacaaaatcttctagaccaactgctctttctgcaattcatactgccagtactagtcatggaggtcaaacaaacccaacaaatttgataatcgatactactaaggagagaatccaaaagctattcaaaaatgttgaaatctcagtatcatcttatgacaccgcatgggttgcaatggtgccatcacctaattccccaaaaagtccatgttttccagagtgcttgaattggttaatcaataatcagttaaacgatggttcttggggtttagtcaaccacactcataaccacaatcatccattattgaaggactctttatcatcaacattagcctgtattgttgcattgaaaagatggaatgtaggtgaagatcaaatcaacaagggtttatcattcatagaatccaatctagcttctgctaccgacaaatcacaaccatctccaatcgggttcgacataatcttccctggtttgctggagtatgccaaaaaccttgatatcaacttactgtctaaacaaacagatttctctttgatgctacacaaaagagagttagagcagaaaagatgccattctaacgaaattgacgggtacttagcatatatctcagaaggtttgggtaatttgtatgactggaacatggtcaaaaagtatcagatgaaaaatggatccgtattcaattctccttctgcaactgccgcagcattcattaatcatcaaaaccctgggtgtcttaactacttgaactcactattagataagtttggaaatgcagttccaacagtctatcctttggacttgtacatcagattatctatggttgacactatagagagattaggtatttctcatcatttcagagttgagatcaaaaatgttttggacgagacatacagatgttgggtcgaaagagatgagcaaatctttatggatgtcgtgacctgcgctctggcttttagattgctaaggatacacggatacaaagtatctcctgatcaactggctgagattacaaacgaactggctttcaaagacgaatacgccgcattagaaacataccatgcatcccaaatactttaccaggaagacctaagttcaggaaaacaaatcttgaagtctgcagatttcctgaaaggcattctgtctacagatagtaataggttgtctaaattgatacacaaggaagtagaaaacgcactaaagtttcctattaacactggtttagagagaatcaatactaggagaaacattcagctgtacaacgtagataatacaaggattcttaagaccacctaccatagttcaaacatttccaacacctattacttaagattagctgtcgaagacttttacacttgtcaatcaatctacagagaggagttaaagggcctagaaagatgggtagttcaaaacaagttggatcaactgaagtttgctagacagaagacagcatactgttatttctctgttgctgctaccctttcatccccagaattgtctgatgccagaataagttgggccaaaaatggtattcttacaactgtagtcgatgatttctttgatattggaggtactattgatgaactgacaaatcttattcaatgtgttgaaaagtggaacgtggatgtagataaggattgctgcagtgaacatgtgagaatacttttcctggctctaaaagatgcaatatgttggattggcgacgaggccttcaagtggcaagctagagatgttacatctcatgtcatccaaacttggcttgaactgatgaactcaatgctaagagaagcaatctggacaagagatgcatacgttccaacattgaacgaatacatggaaaacgcttacgtctcatttgccttgggtcctattgttaagccagccatatactttgttgggccaaagttatccgaagagattgttgagtcttccgaatatcataacctattcaagttaatgtcaacacaaggcagacttctgaacgatatccactccttcaaaagagaattcaaggaaggtaagctaaacgctgttgctttgcacttgtctaatggtgaatctggcaaagtggaagaggaagtcgttgaggaaatgatgatgatgatcaaaaacaagagaaaggaattgatgaaattgattttcgaggaaaatggttcaatcgtacctagagcttgtaaagatgctttttggaatatgtgccatgttcttaacttcttttacgctaatgatgatggcttcactggaaatacaatattggatacagttaaagatatcatctacaacccacttgttttggtcaatgagaacgaggaacaaagataa

SEQ ID NO: 42 - DNA, 1773 bp, Artificial Sequence
  Description of Artificial Sequence: Synthetic polynucleotide
atggctatgccagtgaagctaacacctgcgtcattatccttaaaagctgtgtgctgcagattctcatccggtggccatgctttgagattcgggagtagtctgccatgttggagaaggacccctacccaaagatctacttcttcctctactactagaccagctgccgaagtgtcatcaggtaagagtaaacaacatgatcaggaagctagtgaagcgactatcagacaacaattacaacttgtggatgtcctggagaatatgggaatatccagacattttgctgcagagataaagtgcatactagacagaacttacagatcttggttacaaagacacgaggaaatcatgctggacactatgacatgtgctatggcttttagaatcctaagattgaacggatacaacgtttcatcagatgaactataccacgttgtagaggcatctggtctgcataattctttgggtgggtatcttaacgataccagaacactacttgaattacacaaggcttcaacagttagtatctctgaggatgaatctatcttagattcaattggctctagatccagaacattgcttagagaacaattggagtctggtggcgcactgagaaagccttctttattcaaagaggttgaacatgcactggatggacctttttacaccacacttgatagacttcatcataggtggaatattgaaaacttcaacattattgagcaacacatgttggagactccatacttatctaaccagcatacatcaagggatatcctagcattgtcaattagagatttttcctcctcacaattcacttatcaacaagagctacagcatctggagagttgggttaaggaatgtagattagatcaactacagttcgcaagacagaaattagcgtacttttacctatcagccgcaggcaccatgttttctcctgagctttctgatgcgagaacattatgggccaaaaacggggtgttgacaactattgttgatgatttctttgatgttgccggttctaaagaggaattggaaaacttagtcatgctggtcgaaatgtgggatgaacatcacaaagttgaattctattctgagcaggtcgaaatcatcttctcttccatctacgattctgtcaaccaattgggtgagaaggcctctttggttcaagacagatcaattacaaaacaccttgttgaaatatggttagacttgttaaagtccatgatgacggaagttgaatggagactgtcaaaatacgtgcctacagaaaaggaatacatgattaatgcctctcttatcttcggcctaggtccaatcgttttaccagctttgtatttcgttggtccaaagatttcagaaagtatagtaaaggacccagaatatgatgaattgttcaaactaatgtcaacatgtggtagattgttgaatgacgtgcaaacgttcgaaagagaatacaatgagggtaaactgaattctgtcagtctattggttcttcacggaggcccaatgtctatttcagacgcaaagaggaaattacaaaagcctattgatacgtgtagaagagatcttctttctttggtccttagagaagagtctgtagtaccaagaccatgtaaggaactattctggaaaatgtgtaaagtgtgctatttcttttactcaacaactgatgggttttctagtcaagtcgaaagagcaaaagaggtagacgctgtcataaatgagccactgaagttgcaaggttctcatacactggtatctgatgtttaa

SEQ ID NO: 43 - DNA, 2232 bp, Artificial Sequence
  Description of Artificial Sequence: Synthetic polynucleotide
atgcagaacttccatggtacaaaggaaaggatcaaaaagatgtttgacaagattgaattgtccgtttcttcttatgatacagcctgggttgcaatggtcccatcccctgattgcccagaaacaccttgttttccagaatgtactaaatggatcctagaaaatcagttgggtgatggtagttggtcacttcctcatggcaatccacttctagttaaagatgcattatcttccactcttgcttgtattctggctcttaaaagatggggaatcggtgaggaacagattaacaaaggactgagattcatagaactcaactctgctagtgtaaccgataacgaacaacacaaaccaattggatttgacattatctttccaggtatgattgaatacgctatagacttagacctgaatctaccactaaaaccaactgacattaactccatgttgcatcgtagagcccttgaattgacatcaggtggaggcaaaaatctagaaggtagaagagcttacttggcctacgtctctgaaggaatcggtaagctgcaagattgggaaatggctatgaaataccaacgtaaaaacggatctctgttcaatagtccatcaacaactgcagctgcattcatccatatacaagatgctgaatgcctccactatattcgttctcttctccagaaatttggaaacgcagtccctacaatataccctctcgatatctatgccagactttcaatggtagatgccctggaacgtcttggtattgatagacatttcagaaaggagagaaagttcgttctggatgaaacatacagattttggttgcaaggagaagaggagattttctccgataacgcaacctgtgctttggccttcagaatattgagacttaatggttacgatgtctctcttgaagatcacttctctaactctctgggcggttacttaaaggactcaggagcagctttagaactgtacagagccctccaattgtcttacccagacgagtccctcctggaaaagcaaaattctagaacttcttacttcttaaaacaaggtttatccaatgtctccctctgtggtgacagattgcgtaaaaacataattggagaggtgcatgatgctttaaacttttccgaccacgctaacttacaaagattagctattcgtagaaggattaagcattacgctactgacgatacaaggattctaaaaacttcctacagatgctcaacaatcggtaaccaagattttctaaaacttgcagtggaagatttcaatatctgtcaatcaatacaaagagaggaattcaagcatattgaaagatgggtcgttgaaagacgtctagacaagttaaagttcgctagacaaaaagaggcctattgctatttctcagccgcagcaacattgtttgcccctgaattgtctgatgctagaatgtcttgggccaaaaatggtgtattgacaactgtggttgatgatttcttcgatgtcggaggctctgaagaggaattagttaacttgatagaattgatcgagcgttgggatgtgaatggcagtgcagatttttgtagtgaggaagttgagattatctattctgctatccactcaactatctctgaaataggtgataagtcatttggctggcaaggtagagatgtaaagtctcaagttatcaagatctggctggacttattgaaatcaatgttaactgaagctcaatggtcttcaaacaagtctgttcctaccctagatgagtatatgacaaccgcccatgtttcattcgcacttggtccaattgtacttccagccttatacttcgttggcccaaagttgtcagaagaggttgcaggtcatcctgaactactaaacctctacaaagtcacatctacttgtggcagactactgaatgattggagaagttttaagagagaatccgaggaaggtaagctcaacgctattagtttatacatgatccactccggtggtgcttctacagaagaggaaacaatcgaacatttcaaaggtttgattgattctcagagaaggcaactgttacaattggtgttgcaagagaaggatagtatcatacctagaccatgtaaagatctattttggaatatgattaagttattacacactttctacatgaaagatgatggcttcacctcaaatgagatgaggaatgtagttaaggcaatcattaacgaaccaatctcactggatgaattatga

SEQ ID NO: 44 - DNA, 2355 bp, Stevia rebaudiana
atgaatctttcactatgcatcgcgtcccctttgttaaccaaatcaaatcgacccgcggctctgtcagctattcatacagcatcaacttcacatggtggacaaactaatcccactaatctgatcattgatacaaccaaagaacggatccaaaaacagtttaaaaatgtagaaatttctgtttcttcatatgacacagcatgggtagccatggtcccttctccaaactcacccaaatcgccttgtttccctgagtgtctcaattggttaattaataatcagcttaatgatggttcatggggtcttgttaatcacactcataatcataatcacccgttgcttaaagattctctatcttcaacattagcatgtattgttgcattaaaaagatggaatgttggggaagatcaaataaataaaggtctaagttttattgagtcaaatcttgcttcagctactgaaaaaagtcaaccatctcccattggttttgacatcatatttcctggtttgcttgagtatgcgaaaaacttggacataaacctcctttcaaaacaaacagattttagtttgatgctacataagagggaattggagcaaaaaagatgccattcaaatgagatggatggatacttggcgtatatctctgaaggactcggtaatttatatgattggaatatggtgaagaaatatcagatgaaaaatggttctgttttcaactcaccatcagcaacagctgctgctttcattaatcatcaaaatcctggttgtcttaattatttaaattcacttttggacaagtttggtaatgcagtcccaacagtttatcctcatgatttatttatccgactttctatggttgacacaattgaaagattaggaatttcacaccatttcagagtggaaattaaaaatgttttagatgaaacatacagatgttgggtggaacgagatgagcaaatattcatggatgttgtaacatgtgctttagcctttcggttattaaggatcaatgggtatgaagtttccccagatccattggctgaaattactaatgaattagctttgaaagacgaatatgcagctcttgaaacatatcatgcgtcacatatattataccaagaggatttatcttctggaaaacaaatcttgaagtcagctgatttcctcaaagagataatatccactgattcaaacaggctttctaaattaattcacaaagaggtggaaaatgctcttaagttccctatcaataccggtttagaacgcataaacactagacgaaatatacagctttacaatgtagacaatacaagaattctgaaaactacatatcactcatcaaatattagtaacactgattacctaaggttggctgttgaagatttctacacctgccaatctatttatcgtgaagaattaaaaggtcttgaaaggtgggtggtagagaataagttggaccagctcaagtttgctaggcaaaagaccgcctactgttatttctctgttgctgcaacactttcgtctcccgaattatcagatgcgcgtatttcatgggccaaaaatggcatattaactacagtagttgatgacttttttgatatcggtggtacaatcgatgaattgaccaacctgattcaatgtgttgaaaaatggaatgtagatgtcgacaaggattgttgttcagagcatgttcggattttatttttagcattaaaagatgcaatctgttggattggagatgaagcttttaaatggcaagcgcgcgatgtaactagccatgttattcaaacttggttggaactaatgaatagtatgttgagagaagctatatggacaagagatgcttatgtgccaacattaaatgaatatatggaaaacgcttacgtgtcatttgcattaggcccgattgtcaagccggctatttactttgtggggcccaaattatcagaggagattgttgaaagctctgaatatcataatctatttaagctaatgagcacgcagggtcgacttctaaacgatatccatagcttcaagagggaatttaaggaaggcaaattaaacgcggtagcattgcatttgagtaacggagaaagtgggaaagtggaagaagaggttgtggaggagatgatgatgatgattaaaaacaagaggaaagaattaatgaaattaatttttgaagaaaatggtagcattgttcctagagcttgtaaagatgcattttggaacatgtgtcacgtgttgaattttttttacgcaaacgatgacgggtttactggaaacacgattcttgatactgtgaaggacatcatttacaacccgttggtgcttgtgaatgaaaatgaagaacaaaggtaa

SEQ ID NO: 45 - DNA, 2355 bp, Stevia rebaudiana
atgaatctttcactatgcattgcgtcccctttgttaaccaaatcaagtcgacccacggctctgtcagctattcatacagcatcaacttcacatggtggacaaactaatcccactaatctgatcattgatacaaccaaagaacggatccaaaaactgtttaaaaatgtagaaatttctgtttcttcatatgacacagcatgggtagccatggtcccttctccaaactcacccaaatcgccttgtttccctgagtgtctcaattggttaattaataatcagcttaatgatggttcatggggtcttgttaatcacactcataatcataatcacccgttgcttaaagattctctatcttcaacattagcatgtattgttgcattaaaaagatggaatgttggggaagatcaaataaataaaggtctaagttttattgagtcaaatcttgcttcagcaactgacaaaagtcaaccatctcccattggttttgatatcatatttcctggtttgcttgagtatgcgaaaaacttggacataaacctcctttcaaaacaaacagattttagtttgatgctacataagagggaattggagcaaaaaagatgccattcaaatgagattgatggatacttggcgtatatctctgaaggactcggtaatttatatgattggaatatggtgaagaaatatcagatgaaaaatggttctgttttcaactcaccatcagcaacagcagctgctttcattaatcatcaaaatcccggttgtcttaattatttaaattcacttttggacaagtttggtaatgcagtcccaacagtttatcctcttgatttatatatccggctttctatggttgacacaattgaaagattaggaatttcacaccatttcagagtggaaattaaaaatgttttagatgaaacatacagatgttgggtggaacgagatgagcaaatattcatggatgttgtaacatgtgctttagcctttcggttattaaggatccacgggtataaagtctccccagatcaattggctgaaattactaatgaattagctttcaaagacgaatacgcagctcttgaaacatatcatgcatcacagatattataccaagaggatttatcttctggaaaacaaatcttgaagtcagctgatttcctcaaagggatattatccactgattcaaacaggctttctaaattaattcacaaagaggtggaaaatgctcttaagttccctatcaataccggtttagaacgcataaacactagacgaaatatacagctttacaatgtagacaatacaagaattctgaaaactacatatcactcatcaaatattagtaacacttattacctaaggttggctgttgaagatttctacacctgccaatctatttatcgtgaagaattaaaaggtcttgaaaggtgggtggtacagaataagttggaccagctcaagtttgctaggcaaaagaccgcctactgttatttctctgttgctgcaacactttcgtctcccgaattatcagatgcgcgtatttcatgggccaaaaatggcatattaactacagtagttgatgacttttttgatatcggtggtacaatcgatgaattgaccaacctgattcaatgtgttgaaaaatggaatgtagatgtcgacaaggattgttgttcagagcatgttcggattttatttttagcattaaaagatgcaatctgttggattggagatgaagcttttaaatggcaagcgcgcgatgtaactagccatgttattcaaacttggttggaactaatgaatagtatgttgagagaagctatatggacaagagatgcttatgtgccaacattaaatgaatatatggaaaacgcttacgtgtcatttgcattaggcccgattgtcaagccggctatttactttgtggggcccaaattatcagaggagattgttgaaagctctgaatatcataatctatttaagctaatgagcacgcagggtcgacttctaaacgatatccatagcttcaagagggaatttaaggaaggcaaattaaacgcggtagcattgcatttgagtaacggagaaagtgggaaagtggaagaagaggttgtggaggagatgatgatgatgattaaaaacaagaggaaagaattaatgaaattaatttttgaagaaaatggtagcattgttcctagagcttgtaaagatgcattttggaacatgtgtcacgtgttgaattttttttacgcaaacgatgacgggtttactggaaacacgattcttgatactgtgaaggacatcatttacaacccgttggtgcttgtgaatgaaaatgaagaacaaaggtaa

SEQ ID NO: 46 - DNA, 1773 bp, Zea mays
atggccatgccagtgaagctgactcctgcctccctctcgctgaaggcggtctgctgccgcttcagctccggagggcatgcgctgcgcttcggctcgtcgctaccgtgctggaggaggacgccgacgcaacggagcacgtcgtcgtctacgacgcgccctgcggctgaggttagctctggcaaaagcaagcagcacgatcaagaagcatcggaggctacgataagacagcagctccagctagtcgatgtgcttgagaacatggggatttctcggcattttgctgctgaaatcaaatgcatccttgacaggacatacagaagttggttacagagacatgaggaaattatgctggacacaatgacctgtgcgatggcatttcgtattctaaggttgaatggatacaatgtctcttctgatgagttgtatcatgttgttgaagcttccggactccataattcacttggaggatatctcaatgatacaagaaccttgttagaattacacaaggcctcgacagttagtatctctgaagatgagtctatcctggatagcataggctcaaggtcacgtaccttactgagggaacaactagagtctggtggtgctctacgaaaaccttcactctttaaagaggtggaacatgctctggacggtcccttctacaccacattggaccgtctacaccataggtggaacatcgaaaatttcaatattatagagcagcacatgctagagacaccatacttgtcaaatcaacataccagtagagatattctagcgttgagtattagagacttcagttcctctcagtttacttaccagcaagaacttcaacatcttgaaagctgggtgaaagagtgcaggttagaccagctacaatttgcgcgacagaagttggcatacttctacttgtctgctgctggcaccatgttctctcctgagctgtctgatgctcgaactttgtgggccaaaaatggtgtgctcacaactattgttgacgacttctttgatgttgcgggatcaaaagaagaacttgaaaaccttgtcatgttggttgagatgtgggacgagcatcacaaagttgagttctactcagaacaagtagagattatattttcttcaatttatgactcagttaaccaacttggtgaaaaggcttctttggtacaagaccgcagtattaccaaacacctagtagaaatatggttggatttgctaaagtctatgatgacagaggtagagtggcgtttgagcaaatatgtgccaacagagaaggaatacatgataaatgcatctttaatatttggactaggccccattgtattgccagcattatattttgttgggccaaagatctcagagtctattgttaaagatccagaatatgatgaattgttcaaactgatgagcacatgtggtcgcctcttgaatgatgttcagacttttgagagggagtacaacgagggcaagttgaatagtgtttctctcctcgttcttcatggtggccccatgtccatatcagacgccaaaaggaaattacagaagcccatagacacatgcagaagagacctcctaagtttagttcttcgtgaagaaagtgttgttcctaggccctgcaaggaattattttggaaaatgtgcaaggtgtgctacttcttctactcgacgacggatgggtttagctcacaagtggagagggctaaagaagtggatgcggtgatcaatgagccactaaagctacaaggaagtcatacgctggtgtctgatgtgtga

SEQ ID NO: 47 - DNA, 2232 bp, Populus trichocarpa
atgcagaactttcatggaactaaggaaaggatcaagaagatgtttgataagattgaattgtcagtgtcttcatatgacactgcttgggtggcaatggtcccatctccagattgtccggaaactccttgttttccagagtgcacaaaatggattttggaaaatcaacttggtgatggctcctggagtcttcctcatggcaatccattattagttaaggatgctctttcatctacattagcgtgcatccttgcattgaagcgatggggtatcggtgaagaacaaataaataaaggccttcgatttattgagttgaattccgcttcagttacggataacgagcaacataaaccaattggatttgatataatatttcctggcatgattgaatatgccatagatttggatttgaacctccctttgaagccgacagatataaattccatgctccacaggagggctttggagcttacaagtggcggtggcaagaacttggagggaagaagagcctacttagcatatgtttcggaaggaattggaaaattacaggattgggaaatggccatgaaatatcaaagaaagaatggatcactgttcaattcaccatccaccacagcagctgcctttattcatattcaagatgctgagtgtctccattatattcgttcactcttacagaagtttgggaatgcagttccaaccatttatcctttggatatatatgctcgtctttctatggttgatgctcttgaaaggttgggaatcgatcggcattttaggaaggaaagaaaatttgttttggacgaaacataccgattttggttgcagggggaggaagagatattttctgataatgccacttgtgctttggcatttaggatattacgtttgaacggatatgatgtctctctagaagatcatttctctaattcactgggaggatatttgaaggattcgggagctgccttagagttgtacagagctctgcagctaagttatccagatgaatcacttctggaaaaacaaaattctcggacaagctatttcctgaaacagggattatccaacgtttcactttgtggagataggcttcgtaaaaatattatcggagaggtgcatgatgctctcaatttttctgaccatgcaaatttgcaacgcttagctatcagaagaagaattaaacattatgctacagatgatacgaggattttgaaaacttcgtatcgttgttcgactattggtaaccaggattttctcaaattggctgtagaagacttcaatatctgtcaatcaatacagcgtgaagaatttaaacatatcgagaggtgggttgtagagaggagactggacaagctaaagtttgctaggcagaaggaggcctactgttacttctctgctgcagcaactctcttcgctccagaactatctgatgcacgcatgtcatgggcaaaaaatggtgtgcttactactgttgttgatgacttctttgatgttggtggttctgaagaagaactggtaaaccttattgaattgattgagaggtgggatgtcaatggcagtgctgatttttgttctgaggaagttgagatcatatattcggcaattcacagcactataagtgagataggagacaaatctttcggatggcaaggacgcgatgtgaaaagtcaggttatcaagatttggttggatttgctcaaatccatgttgacagaagcacaatggtcaagtaacaaatcagtgccgacccttgatgaatatatgacaactgcacatgtatcgttcgctctagggcctattgttcttccagctctgtattttgtggggcctaagctttcagaggaggttgctggacatcctgaattgcttaatctatacaaggttacgagcacttgcgggcgtctgctcaatgactggagaagctttaagagagaatctgaagaagggaaattgaatgccatctcattgtacatgattcacagcggtggtgcttcaactgaagaagagaccatcgaacattttaaaggattgatcgacagccagagaagacaattgcttcaattagttttgcaggaaaaggatagtataattcctagaccctgcaaggatttgttttggaacatgataaaattattgcacacgttctacatgaaggatgatggattcacttcaaacgagatgagaaatgttgtcaaggcaataataaatgaacccatctctctagatgaattataa

SEQ ID NO: 48 - DNA, 2952 bp, Artificial Sequence
  Description of Artificial Sequence: Synthetic polynucleotide
atggaatttgatgaaccattggttgacgaagcaagatctttagtgcagcgtactttacaagattatgatgacagatacggcttcggtactatgtcatgtgctgcttatgatacagcctgggtgtctttagttacaaaaacagtcgatgggagaaaacaatggcttttcccagagtgttttgaatttctactagaaacacaatctgatgccggaggatgggaaatcgggaattcagcaccaatcgacggtatattgaatacagctgcatccttacttgctctaaaacgtcacgttcaaactgagcaaatcatccaacctcaacatgaccataaggatctagcaggtagagctgaacgtgccgctgcatctttgagagcacaattggctgcattggatgtgtctacaactgaacacgtcggttttgagataattgttcctgcaatgctagacccattagaagccgaagatccatctctagttttcgattttccagctaggaaacctttgatgaagattcatgatgctaagatgagtagattcaggccagaatacttgtatggcaaacaaccaatgaccgccttacattcattagaggctttcataggcaaaatcgacttcgataaggtaagacaccaccgtacccatgggtctatgatgggttctccttcatctaccgcagcctacttaatgcacgcttcacaatgggatggtgactcagaggcttaccttagacacgtgattaaacacgcagcagggcagggaactggtgctgtaccatctgctttcccatcaacacattttgagtcatcttggattcttaccacattgtttagagctggattttcagcttctcatcttgcctgtgatgagttgaacaagttggtcgagatacttgagggctcattcgagaaggaaggtggggcaatcggttacgctccagggtttcaagcagatgttgatgatactgctaaaacaataagtacattagcagtccttggaagagatgctacaccaagacaaatgatcaaggtatttgaagctaatacacattttagaacataccctggtgaaagagatccttctttgacagctaattgtaatgctctatcagccttactacaccaaccagatgcagcaatgtatggatctcaaattcaaaagattaccaaatttgtctgtgactattggtggaagtctgatggtaagattaaagataagtggaacacttgctacttgtacccatctgtcttattagttgaggttttggttgatcttgttagtttattggagcagggtaaattgcctgatgttttggatcaagagcttcaatacagagtcgccatcacattgttccaagcatgtttaaggccattactagaccaagatgccgaaggatcatggaacaagtctatcgaagccacagcctacggcatccttatcctaactgaagctaggagagtttgtttcttcgacagattgtctgagccattgaatgaggcaatccgtagaggtatcgctttcgccgactctatgtctggaactgaagctcagttgaactacatttggatcgaaaaggttagttacgcacctgcattattgactaaatcctatttgttagcagcaagatgggctgctaagtctcctttaggcgcttccgtaggctcttctttgtggactccaccaagagaaggattggataagcatgtcagattattccatcaagctgagttattcagatcccttccagaatgggaattaagagcctccatgattgaagcagctttgttcacaccacttctaagagcacatagactagacgttttccctagacaagatgtaggtgaagacaaatatcttgatgtagttccattcttttggactgccgctaacaacagagatagaacttacgcttccactctattcctttacgatatgtgttttatcgcaatgttaaacttccagttagacgaattcatggaggccacagccggtatcttattcagagatcatatggatgatttgaggcaattgattcatgatcttttggcagagaaaacttccccaaagagttctggtagaagtagtcagggcacaaaagatgctgactcaggtatagaggaagacgtgtcaatgtccgattcagcttcagattcccaggatagaagtccagaatacgacttggttttcagtgcattgagtacctttacaaaacatgtcttgcaacacccatctatacaaagtgcctctgtatgggatagaaaactacttgctagagagatgaaggcttacttacttgctcatatccaacaagcagaagattcaactccattgtctgaattgaaagatgtgcctcaaaagactgatgtaacaagagtttctacatctactactaccttctttaactgggttagaacaacttccgcagaccatatatcctgcccatactccttccactttgtagcatgccatctaggcgcagcattgtcacctaaagggtctaacggtgattgctatccttcagctggtgagaagttcttggcagctgcagtctgcagacatttggccaccatgtgtagaatgtacaacgatcttggatcagctgaacgtgattctgatgaaggtaatttgaactccttggacttccctgaattcgccgattccgcaggaaacggagggatagaaattcagaaggccgctctattaaggttagctgagtttgagagagattcatacttagaggccttccgtcgtttacaagatgaatccaatagagttcacggtccagccggtggtgatgaagccagattgtccagaaggagaatggcaatccttgaattcttcgcccagcaggtagatttgtacggtcaagtatacgtcattagggatatttccgctcgtattcctaaaaacgaggttgagaaaaagagaaaattggatgatgctttcaattga

SEQ ID NO: 49 - DNA, 2646 bp, Artificial Sequence
  Description of Artificial Sequence: Synthetic polynucleotide
atggcttctagtacacttatccaaaacagatcatgtggcgtcacatcatctatgtcaagttttcaaatcttcagaggtcaaccactaagatttcctggcactagaaccccagctgcagttcaatgcttgaaaaagaggagatgccttaggccaaccgaatccgtactagaatcatctcctggctctggttcatatagaatagtaactggcccttctggaattaaccctagttctaacgggcacttgcaagagggttccttgactcacaggttaccaataccaatggaaaaatctatcgataacttccaatctactctatatgtgtcagatatttggtctgaaacactacagagaactgaatgtttgctacaagtaactgaaaacgtccagatgaatgagtggattgaggaaattagaatgtactttagaaatatgactttaggtgaaatttccatgtccccttacgacactgcttgggtggctagagttccagcgttggacggttctcatgggcctcaattccacagatctttgcaatggattatcgacaaccaattaccagatggggactggggcgaaccttctcttttcttgggttacgatagagtttgtaatactttagcctgtgtgattgcgttgaaaacatggggtgttggggcacaaaacgttgaaagaggaattcagttcctacaatctaacatatacaagatggaggaagatgacgctaatcatatgccaataggattcgaaatcgtattccctgctatgatggaagatgccaaagcattaggtttggatttgccatacgatgctactattttgcaacagatttcagccgaaagagagaaaaagatgaaaaagatcccaatggcaatggtgtacaaatacccaaccactttacttcactccttagaaggcttgcatagagaagttgattggaataagttgttacaattacaatctgaaaatggtagttttctttattcacctgcttcaaccgcatgcgccttaatgtacactaaggacgttaaatgttttgattacttaaaccagttgttgatcaagttcgaccacgcatgcccaaatgtatatccagtcgatctattcgaaagattatggatggttgacagattgcagagattagggatctccagatactttgaaagagagattagagattgtttacaatacgtctacagatattggaaagattgtggaatcggatgggcttctaactcttccgtacaagatgttgatgatacagccatggcgtttagacttttaaggactcatggtttcgacgtaaaggaagattgctttagacagtttttcaaggacggagaattcttctgcttcgcaggccaatcatctcaagcagttacaggcatgtttaatctttcaagagccagtcaaacattgtttccaggagaatctttattgaaaaaggctagaaccttctctagaaacttcttgagaacaaagcatgagaacaacgaatgtttcgataaatggatcattactaaagatttggctggtgaagtcgagtataacttgaccttcccatggtatgcctctttgcctagattagaacataggacatacttagatcaatatggaatcgatgatatctggataggcaaatctttatacaaaatgcctgctgttaccaacgaagttttcctaaagttggcaaaggcagactttaacatgtgtcaagctctacacaaaaaggaattggaacaagtgataaagtggaacgcgtcctgtcaattcagagatcttgaattcgccagacaaaaatcagtagaatgctattttgctggtgcagccacaatgttcgaaccagaaatggttcaagctagattagtctgggcaagatgttgtgtattgacaactgtcttagacgattactttgaccacgggacacctgttgaggaacttagagtgtttgttcaagctgtcagaacatggaatccagagttgatcaacggtttgccagagcaagctaaaatcttgtttatgggcttatacaaaacagttaacacaattgcagaggaagcattcatggcacagaaaagagacgtccatcatcatttgaaacactattgggacaagttgataacaagtgccctaaaggaggccgaatgggcagagtcaggttacgtcccaacatttgatgaatacatggaagtagctgaaatttctgttgctctagaaccaattgtctgtagtaccttgttctttgcgggtcatagactagatgaggatgttctagatagttacgattaccatctagttatgcatttggtaaacagagtcggtagaatcttgaatgatatacaaggcatgaagagggaggcttcacaaggtaagatctcatcagttcaaatctacatggaggaacatccatctgttccatctgaggccatggcgatcgctcatcttcaagagttagttgataattcaatgcagcaattgacatacgaagttcttaggttcactgcggttccaaaaagttgtaagagaatccacttgaatatggctaaaatcatgcatgccttctacaaggatactgatggattctcatcccttactgcaatgacaggattcgtcaaaaaggttcttttcgaacctgtgcctgagtaa

SEQ ID NO: 50 - DNA, 2952 bp, Phomopsis amygdali
atggagttcgatgaaccacttgtggacgaggcgaggtccttggtccaaagaaccctgcaagattatgacgaccgctatggctttggcactatgagctgtgcggcctatgacacagcatgggtatcgctggtgactaaaacagtcgatgggcgtaaacaatggttgttccctgagtgcttcgaatttctcctagaaacgcagtccgatgctggcggctgggaaatcggcaacagcgcacccatcgatgggatccttaacactgctgcttcactgctggcattgaagcgccacgtccaaacagagcagattattcagccgcaacacgaccataaagacctggccgggcgtgcggaaagagcggcggcgtctttgcgagcacagttggcggctctggatgtgtcgacaacggagcatgtgggcttcgaaatcatcgtcccggccatgctcgaccctctcgaggccgaagacccgtctttggtgttcgactttccagcacgcaaaccactgatgaagatccacgacgctaagatgtcgcgattccgaccagagtacctctacggtaaacagccgatgacggcattgcattcgctcgaggcctttatcgggaaaatagacttcgacaaagtacggcatcacaggacacacggttcgatgatggggtcgccctcgtcgacggctgcatacctgatgcatgcttctcagtgggacggcgactctgaggcctatctacgccatgtcatcaagcacgcagctggccagggcaccggagctgttccgagtgcatttccttcgacgcatttcgagtcttcttggattttgacaacattgtttcgagctgggttctcagcctctcatctagcatgcgacgaattaaacaagctggtagagatcctcgaaggctcatttgagaaagaagggggagccatcggttatgctcctgggtttcaagcagatgtggatgataccgcaaagaccatctccactttggctgtgcttgggagagatgccactccccggcaaatgatcaaggtttttgaagccaatacacactttcggacttaccctggtgaaagagatccaagcttgactgccaattgcaacgcgctctcggctcttcttcaccagccagacgcagcaatgtacggcagccagatccagaagatcacaaagtttgtttgtgactactggtggaaaagtgacggcaaaatcaaggacaagtggaatacctgctacttgtatccatcggtcctcctcgtcgaggtgttagtagaccttgtgtccctgttggagcaaggaaagctacccgacgtgctggatcaggagctgcaatacagggtcgccattacgttattccaggcctgcttgcgaccgctacttgatcaagatgctgaaggttcatggaacaaatccattgaagccacagcctacggcattctaatccttacggaggcgcggcgagtatgcttttttgaccgtctgagtgagcctctgaatgaggctattcgacgcgggattgcgtttgcagattcgatgagcggtactgaagctcagctgaattatatatggatcgagaaagtgagctacgcacctgctcttctgaccaaatcatacctcctcgcagctcggtgggcggcaaagtccccgcttggcgcttccgttggatccagcctttggacgcctccaagagaaggcttggataagcacgtccgtctattccaccaggcagagctcttcaggtcgttgccggagtgggagctgcgcgcgtccatgatcgaggcagccctgttcactcctttgctgcgtgcgcataggctggatgtatttccacgccaagacgtcggcgaggacaagtacctggacgttgtgccgttcttctggacggccgccaataaccgcgatcgcacgtacgcatccactctgtttctgtatgacatgtgctttatcgccatgcttaacttccagctggatgagttcatggaggctacagcgggaatcctcttccgggaccatatggatgatttgcgccaactcatccacgacctgcttgccgaaaagacgagccccaagtcatcgggcagaagtagccaaggaaccaaagacgcggactcgggcatcgaagaagacgtttctatgagcgactcagcgtcagactcccaggaccgcagccctgaatacgacctggtcttctctgcgctctctaccttcaccaaacatgtcctgcagcacccttcaatccagtcagccagtgtctgggataggaaactactcgctcgcgagatgaaagcatacctcctagctcatattcaacaggctgaggacagcacgcccttgagtgagctcaaggacgtccctcaaaaaactgacgtgacacgcgtctcaacgtccacaacgactttcttcaactgggtacgcacaacatccgcagaccacatatcctgcccatattcattccatttcgtggcgtgtcacctcggcgccgcgctgagccccaagggcagcaacggcgactgttacccgtcagccggtgaaaagttcctcgcggccgccgtatgccgccatttggccacgatgtgccgcatgtacaatgacttgggatcggcggagcgcgacagtgacgagggaaatttgaattcactcgactttcccgagttcgccgactcagcggggaatggtgggattgagatccagaaagctgccttgctcaggctggccgagttcgaacgcgactcgtatctcgaggctttccggcgacttcaggatgaaagcaaccgcgttcacggaccggctggtggggatgaagccagactcagcaggcggcgcatggccatccttgagttctttgcccagcaggtggacttgtatggccaggtctacgttattcgcgatatctcggccaggattccaaagaacgaggttgagaagaaaaggaaactagatgatgctttcaattag

SEQ ID NO: 51 - DNA, 2646 bp, Physcomitrella patens
atggcttccagcaccttgatacagaatcgctcttgtggcgttacgtcaagcatgtcttcctttcagatttttcgagggcaacctctacgttttccaggcactagaactcctgctgcagttcaatgcctaaagaagcgtcgatgtttgcgacctactgaatcagtcctcgagagctctcctggtagcggatcttacaggattgtaactggaccctccggcatcaatccttcttcaaacggccacttgcaagaggggtcccttactcacagacttccgatacccatggaaaaatccattgataacttccagtctactttgtacgtatcagacatatggtcagaaaccttgcaaagaacggaatgtttgttgcaggtgactgagaatgtacagatgaacgagtggattgaggaaatcagaatgtacttccgaaatatgacactgggggaaatatccatgtctccatacgacacagcttgggtagcgcgagtgccagcgctggatggctcacatggccctcagttccatcggtctttgcagtggattattgataatcagctcccggatggcgattggggtgaaccgtctcttttccttggatacgatcgcgtttgcaacactctcgcctgtgtaattgccctgaaaacttggggtgttggggctcagaacgtagagcgtggaatccagtttctgcaatctaacatctacaaaatggaggaagatgacgccaatcatatgccgattggatttgagattgtcttcccagcgatgatggaagatgccaaggcactgggactggatttaccatacgatgccactatcttgcaacaaatctcggctgaaagagagaagaaaatgaaaaagattcctatggcgatggtgtacaagtaccccactactttgctgcattctctggaaggcctgcaccgggaagtggactggaacaagctcctccagctacagtccgagaatggctcctttctgtattcacccgcatccactgcatgcgcacttatgtacacaaaagatgtgaagtgcttcgactacttgaaccagctcctcatcaagttcgaccacgcttgtccaaacgtgtaccccgttgatctcttcgagcgtttgtggatggtagaccgcctacaaaggctgggaatatcccgctacttcgagcgagaaatcagagactgtctacaatatgtataccgatactggaaggattgtggtattggctgggcaagcaattcgtccgtgcaggacgtggacgacacggccatggccttccgccttctccgcacacacggattcgacgtcaaggaggactgcttcagacagtttttcaaagatggtgagttcttctgcttcgccggccagtccagccaagccgtcacgggaatgttcaacctcagcagagcatcgcaaacgctcttcccaggggaatcactcctaaaaaaggccagaaccttttccagaaactttttgagaaccaagcatgaaaacaatgaatgcttcgacaagtggataatcacgaaggatctagcgggcgaggtggaatacaatctcacattcccctggtatgctagccttcctcgtcttgagcatcgcacctacttggaccaatatgggattgatgatatctggattggcaagtcgctctacaaaatgccggccgtcaccaacgaagtgtttctcaaattggccaaagccgacttcaacatgtgccaagctcttcacaagaaggaactcgagcaggtcatcaaatggaatgccagctgccaatttagagacctcgagtttgctagacagaaatccgtggagtgctacttcgcaggcgctgcaaccatgtttgagcccgaaatggtgcaggcgaggctcgtttgggcacgctgttgcgtgctcaccaccgttctagacgattacttcgatcacggtacacctgtggaagagcttcgggtttttgtgcaggccgtaaggacttggaatcccgagctcatcaacggactacctgagcaagccaagattctctttatgggactgtacaagactgtgaacactatcgccgaggaggcattcatggcacagaaacgagacgtacatcatcatctcaagcattactgggacaaattgatcacttcagctttgaaagaagccgaatgggcagagtccggctacgtccccaccttcgacgagtatatggaagtcgctgaaatctccgtcgcactagagcccattgtatgtagcactctcttcttcgccggccataggctcgatgaggatgtgcttgacagttatgactaccatcttgtcatgcatctcgtcaaccgcgtaggtcgcatcctcaacgacatccaaggaatgaagagggaagccagccaagggaagatatcgagcgtgcagatctacatggaggagcatccaagtgtgccttcagaggccatggccatcgctcatctgcaggaattggtcgacaactccatgcaacagctgacatacgaagtgctgcgcttcactgcagtcccgaagtcctgtaagagaatccatttaaacatggcgaagatcatgcacgctttctacaaggacactgatgggttttcgtcactgacagccatgacagggtttgtgaagaaggtgctcttcgagccagtacctgaatag

SEQ ID NO: 52 - DNA, 1542 bp, Artificial Sequence
  Description of Artificial Sequence: Synthetic polynucleotide
atggatgctgtgacgggtttgttaactgtcccagcaaccgctataactattggtggaactgctgtagcattggcggtagcgctaatcttttggtacctgaaatcctacacatcagctagaagatcccaatcaaatcatcttccaagagtgcctgaagtcccaggtgttccattgttaggaaatctgttacaattgaaggagaaaaagccatacatgacttttacgagatgggcagcgacatatggacctatctatagtatcaaaactggggctacaagtatggttgtggtatcatctaatgagatagccaaggaggcattggtgaccagattccaatccatatctacaaggaacttatctaaagccctgaaagtacttacagcagataagacaatggtcgcaatgtcagattatgatgattatcataaaacagttaagagacacatactgaccgccgtcttgggtcctaatgcacagaaaaagcatagaattcacagagatatcatgatggataacatatctactcaacttcatgaattcgtgaaaaacaacccagaacaggaagaggtagaccttagaaaaatctttcaatctgagttattcggcttagctatgagacaagccttaggaaaggatgttgaaagtttgtacgttgaagacctgaaaatcactatgaatagagacgaaatctttcaagtccttgttgttgatccaatgatgggagcaatcgatgttgattggagagacttctttccatacctaaagtgggtcccaaacaaaaagttcgaaaatactattcaacaaatgtacatcagaagagaagctgttatgaaatctttaatcaaagagcacaaaaagagaatagcgtcaggcgaaaagctaaatagttatatcgattaccttttatctgaagctcaaactttaaccgatcagcaactattgatgtccttgtgggaaccaatcattgaatcttcagatacaacaatggtcacaacagaatgggcaatgtacgaattagctaaaaaccctaaattgcaagataggttgtacagagacattaagtccgtctgtggatctgaaaagataaccgaagagcatctatcacagctgccttacattacagctattttccacgaaacactgagaagacactcaccagttcctatcattcctctaagacatgtacatgaagataccgttctaggcggctaccatgttcctgctggcacagaacttgccgttaacatctacggttgcaacatggacaaaaacgtttgggaaaatccagaggaatggaacccagaaagattcatgaaagagaatgagacaattgattttcaaaagacgatggccttcggtggtggtaagagagtttgtgctggttccttgcaagcccttttaactgcatctattgggattgggagaatggttcaagagttcgaatggaaactgaaggatatgactcaagaggaagtgaacacgataggcctaactacacaaatgttaagaccattgagagctattatcaaacctaggatctaa

SEQ ID NO: 53 - DNA, 1530 bp, Artificial Sequence
  Description of Artificial Sequence: Synthetic polynucleotide
atggcatttttctctatgatttcaattttgttgggatttgttatttcttctttcatcttcatctttttcttcaaaaagttacttagttttagtaggaaaaacatgtcagaagtttctactttgccaagtgttccagtagtgcctggttttccagttattgggaatttgttgcaactaaaggagaaaaagcctcataaaactttcactagatggtcagagatatatggacctatctactctataaagatgggttcttcatctcttattgtattgaacagtacagaaactgctaaggaagcaatggtcactagattttcatcaatatctaccagaaaattgtcaaacgccctaacagttctaacctgcgataagtctatggtcgccacttctgattatgatgacttccacaaattagttaagagatgtttgctaaatggacttcttggtgctaatgctcaaaagagaaaaagacactacagagatgctttgattgaaaatgtgagttccaagctacatgcacacgctagagatcatccacaagagccagttaactttagagcaattttcgaacacgaattgtttggtgtagcattaaagcaagccttcggtaaagacgtagaatccatatacgtcaaggagttaggcgtaacattatcaaaagatgaaatctttaaggtgcttgtacatgatatgatggagggtgcaattgatgtagattggagagatttcttcccatatttgaaatggatccctaataagtcttttgaagctaggatacaacaaaagcacaagagaagactagctgttatgaacgcacttatacaggacagattgaagcaaaatgggtctgaatcagatgatgattgttaccttaacttcttaatgtctgaggctaaaacattgactaaggaacagatcgcaatccttgtctgggaaacaatcattgaaacagcagatactaccttagtcacaactgaatgggccatatacgagctagccaaacatccatctgtgcaagataggttgtgtaaggagatccagaacgtgtgtggtggagagaaattcaaggaagagcagttgtcacaagttccttaccttaacggcgttttccatgaaaccttgagaaaatactcacctgcaccattagttcctattagatacgcccacgaagatacacaaatcggtggctaccatgttccagctgggtccgaaattgctataaacatctacgggtgcaacatggacaaaaagagatgggaaagaccagaagattggtggccagaaagattcttagatgatggcaaatatgaaacatctgatttgcataaaacaatggctttcggagctggcaaaagagtgtgtgccggtgctctacaagcctccctaatggctggtatcgctattggtagattggtccaagagttcgaatggaaacttagagatggtgaagaggaaaatgtcgatacttatgggttaacatctcaaaagttatacccactaatggcaatcatcaatcctagaagatcctaa

SEQ ID NO: 54 - DNA, 1578 bp, Artificial Sequence
  Description of Artificial Sequence: Synthetic polynucleotide
atgagtaagtctaatagtatgaattctacatcacacgaaaccctttttcaacaattggtcttgggtttggaccgtatgccattgatggatgttcactggttgatctacgttgctttcggcgcatggttatgttcttatgtgatacatgttttatcatcttcctctacagtaaaagtgccagttgttggatacaggtctgtattcgaacctacatggttgcttagacttagattcgtctgggaaggtggctctatcataggtcaagggtacaataagtttaaagactctattttccaagttaggaaattgggaactgatattgtcattataccacctaactatattgatgaagtgagaaaattgtcacaggacaagactagatcagttgaacctttcattaatgattttgcaggtcaatacacaagaggcatggttttcttgcaatctgacttacaaaaccgtgttatacaacaaagactaactccaaaattggtttccttgaccaaggtcatgaaggaagagttggattatgctttaacaaaagagatgcctgatatgaaaaatgacgaatgggtagaagtagatatcagtagtataatggtgagattgatttccaggatctccgccagagtctttctagggcctgaacactgtcgtaaccaggaatggttgactactacagcagaatattcagaatcacttttcattacagggtttatcttaagagttgtacctcatatcttaagaccattcatcgcccctctattaccttcatacaggactctacttagaaacgtttcaagtggtagaagagtcatcggtgacatcataagatctcagcaaggggatggtaacgaagatatactttcctggatgagagatgctgccacaggagaggaaaagcaaatcgataacattgctcagagaatgttaattctttctttagcatcaatccacactactgcgatgaccatgacacatgccatgtacgatctatgtgcttgccctgagtacattgaaccattaagagatgaagttaaatctgttgttggggcttctggctgggacaagacagcgttaaacagatttcataagttggactccttcctaaaagagtcacaaagattcaacccagtattcttattgacattcaatagaatctaccatcaatctatgaccttatcagatggcactaacattccatctggaacacgtattgctgttccatcacacgcaatgttgcaagattctgcacatgtcccaggtccaaccccacctactgaatttgatggattcagatatagtaagatacgttctgatagtaactacgcacaaaagtacctattctccatgaccgattcttcaaacatggctttcggatacggcaagtatgcttgtccaggtagattttacgcgtctaatgagatgaaactaacattagccattttgttgctacaatttgagttcaaactaccagatggtaaaggtcgtcctagaaatatcactatcgattctgatatgattccagacccaagagctagactttgcgtcagaaaaagatcacttagagatgaatga

SEQ ID NO: 55 - DNA, 1500 bp, Artificial Sequence
  Description of Artificial Sequence: Synthetic polynucleotide
atggaagatcctactgtcttatatgcttgtcttgccattgcagttgcaactttcgttgttagatggtacagagatccattgagatccatcccaacagttggtggttccgatttgcctattctatcttacatcggcgcactaagatggacaagacgtggcagagagatacttcaagagggatatgatggctacagaggatctacattcaaaatcgcgatgttagaccgttggatcgtgatcgcaaatggtcctaaactagctgatgaagtcagacgtagaccagatgaagagttaaactttatggacggattaggagcattcgtccaaactaagtacaccttaggtgaagctattcataacgatccataccatgtcgatatcataagagaaaaactaacaagaggccttccagccgtgcttcctgatgtcattgaagagttgacacttgcggttagacagtacattccaacagaaggtgatgaatgggtgtccgtaaactgttcaaaggccgcaagagatattgttgctagagcttctaatagagtctttgtaggtttgcctgcttgcagaaaccaaggttacttagatttggcaatagactttacattgtctgttgtcaaggatagagccatcatcaatatgtttccagaattgttgaagccaatagttggcagagttgtaggtaacgccaccagaaatgttcgtagagctgttccttttgttgctccattggtggaggaaagacgtagacttatggaagagtacggtgaagactggtctgaaaaacctaatgatatgttacagtggataatggatgaagctgcatccagagatagttcagtgaaggcaatcgcagagagattgttaatggtgaacttcgcggctattcatacctcatcaaacactatcactcatgctttgtaccaccttgccgaaatgcctgaaactttgcaaccacttagagaagagatcgaaccattagtcaaagaggagggctggaccaaggctgctatgggaaaaatgtggtggttagattcatttctaagagaatctcaaagatacaatggcattaacatcgtatctttaactagaatggctgacaaagatattacattgagtgatggcacatttttgccaaaaggtactctagtggccgttccagcgtattctactcatagagatgatgctgtctacgctgatgccttagtattcgatcctttcagattctcacgtatgagagcgagagaaggtgaaggtacaaagcaccagttcgttaatacttcagtcgagtacgttccatttggtcacggaaagcatgcttgtccaggaagattcttcgccgcaaacgaattgaaagcaatgttggcttacattgttctaaactatgatgtaaagttgcctggtgacggtaaacgtccattgaacatgtattggggtccaacagttttgcctgcaccagcaggccaagtattgttcagaaagagacaagttagtctataa

SEQ ID NO: 56 - DNA, 1542 bp, Stevia rebaudiana
atggatgccgtcaccggtttgctgacagttccggcaaccgcaataaccatcggcggtacggccgtcgcactcgccgtcgctctgatattctggtacctcaaaagctacacatctgcacgcaggagccaatcaaaccatctccctcgggttcccgaggtacctggtgtgccattattggggaatttattgcagttgaaggagaagaaaccttacatgacttttacaagatgggcggcaacttatggtccgatttattcgattaaaaccggagcaacttctatggtggtcgtcagttcaaatgaaattgcaaaggaggcattggttaccagatttcaatctatctcaaccagaaacctatcaaaggcattaaaggttctcacagcagataaaaccatggtggcgatgagtgattatgatgattatcataagactgtcaaacgccatatactgaccgctgttttgggaccaaatgctcagaagaaacaccgcatccatagggacatcatgatggataatatatcaacccaacttcatgaatttgttaaaaataatcctgaacaagaggaagtggatctaaggaaaatattccaatccgaactttttggattagctatgagacaagcattgggaaaggatgtggagagcttatatgttgaggatcttaaaatcaccatgaaccgagacgagatatttcaggtattggttgttgacccgatgatgggtgcaattgacgtcgactggagagatttcttcccgtatctaaagtgggtcccgaataaaaagtttgaaaacacgatccaacaaatgtatatccggagagaagctgtgatgaagtctcttattaaagaacataaaaaacgtattgcatccggagagaaattaaacagctacattgattacttgctatcggaagcacaaacgttaaccgatcaacaactacttatgtctctatgggaacctattattgaatcatcagacaccactatggttacaactgaatgggctatgtatgaacttgcaaaaaaccccaaacttcaggatcgtttgtatcgggatatcaaaagtgtttgcgggtcagagaagattacagaagaacacttgtctcaactgccatacataactgccatttttcatgaaaccttgagaaggcatagtccagttcctataattccattaagacacgtgcatgaagacacagtgttaggagggtaccatgtgccagctggaaccgagctagcggtaaacatttatggatgtaacatggataagaatgtgtgggagaatcctgaagaatggaatccagagagattcatgaaggaaaatgaaacgatagatttccagaaaacaatggcgtttggaggtggaaagcgcgtatgtgctggttcgcttcaagcattgttgactgcttccattggaattggaagaatggtgcaagagtttgagtggaaactgaaagayatgacccaagaagaagttaatacgattgggcttacgacccagatgcttcgtccactgcgggccataataaagcccaggatatga

SEQ ID NO: 57 - DNA, 1530 bp, Arabidopsis thaliana
atggccttcttctccatgatctccattctccttggctttgttatctcctccttcatcttcatcttcttcttcaagaaacttctctccttctccagaaagaacatgtctgaagtctccactctcccctctgttccagtggtaccagggtttcctgttattgggaacttgctgcaactaaaagagaagaaacctcacaagactttcactagatggtcagagatttatggtcctatttactctataaagatgggttcttcttctcttattgtcctcaattctactgagactgccaaagaggccatggtgacgcggttttcgtctatctcaacgaggaagttgtcaaatgcgttgacagtccttacttgtgacaaatctatggttgctactagtgattatgatgatttccacaagttggtgaaacggtgtctcttgaacggtcttttgggtgctaatgcacagaaacgaaaaagacattacagagatgcactcattgaaaatgtgtcttccaagttgcatgcccatgctagggaccatccacaagaacctgtaaacttcagagctatatttgagcatgagcttttcggtgtagcattgaagcaagcttttgggaaagatgtggaatccatttatgttaaagaactcggtgtgactttgtcgaaagacgagatcttcaaggttttagtacatgacatgatggaaggtgcaattgatgttgattggagagacttcttcccatacttgaaatggattccaaataaaagttttgaagcaagaatccagcaaaagcataaacgtagactcgcggtgatgaatgctctgattcaagatcgactgaagcagaatggttcagaatcggatgatgattgctatctcaacttcttgatgtcggaagcgaaaacactaaccaaggagcaaattgctatcttggtttgggagacgattatcgagacagctgacactactttggttacaactgaatgggccatctatgagctcgctaagcatccaagtgtccaagatcgtctgtgtaaagaaatccaaaatgtctgcggaggagaaaagttcaaagaagagcaattgtctcaagttccttatctcaatggagtattccatgaaacgcttaggaaatacagtcctgctcctctagtccccattcgctatgcccacgaagatacgcaaatcggaggctatcatgtccctgcaggaagtgagattgcaataaacatctatggatgcaacatggataagaagcgttgggagagaccagaggactggtggccggagcggtttcttgatgatggcaaatacgaaacgtcggatcttcacaagacaatggcgtttggagcgggaaagagggtttgtgctggtgctcttcaagcatctctcatggcaggcattgccattgggaggttagtgcaagaattcgagtggaagcttagagacggtgaagaagagaatgtggatacatatggcttgacctctcagaagctttatcctcttatggctattatcaatccaaggcgttcttaa

SEQ ID NO: 58 - DNA, 1578 bp, Gibberella fujikoroi
atgagtaagtccaacagcatgaacagtaccagccatgaaacgttattccagcagctcgtcttaggtcttgacagaatgccgctaatggacgttcactggctgatctacgtggcctttggcgcttggttatgctcttatgtcatccatgtcctatcgtcctcttctacagtcaaagtgcccgtcgtaggctaccgcagcgtctttgagcctacatggcttctccgtttgcgctttgtttgggaagggggatctatcatcggccaaggctacaacaaatttaaagactctatcttccaggtgcgaaagcttggtaccgatatcgtcatcatcccgccaaactacatcgatgaggtcagaaagctgtcccaagacaagactcgctcggtcgagcccttcatcaatgactttgcgggacagtatacacggggcatggtctttctgcaaagtgatttgcagaaccgtgtgattcagcagcggttgacgccaaaactcgtatcgttgacaaaggtaatgaaggaggagcttgactatgccttgaccaaagagatgcctgacatgaagaatgatgaatgggttgaagtcgacatttcttccatcatggtcaggctcatatcacgcatctcagccagagtgtttctcggtccagagcactgccgcaaccaagaatggttgacgaccactgcagagtacagcgagagcctgttcataactggctttattctccgcgttgtcccccatattctaagaccattcatagccccgctgctaccctcctacagaacactacttcgcaacgtctcgtcaggtcgaagagttattggagacatcattcgctcccagcaaggtgatggcaacgaggacatcctgtcatggatgagggatgctgcgacaggggaagaaaagcaaattgacaacattgcccagcggatgcttatcctgagtctcgcgtctattcacactacggcaatgacgatgacgcatgctatgtatgacttatgtgcttgccctgagtacatagagcctcttagagatgaggtcaaaagtgtcgttggcgctagtggttgggacaagacggcgttgaatcgattccacaaactcgacagctttctcaaagagtcacaacgcttcaaccccgtgttcctcttaacgttcaatcgcatttatcaccaatccatgacactctcagatggcaccaacatcccatcaggcactcgcatcgcggttccctctcacgcgatgcttcaggactcagcgcatgtcccaggcccgacgccaccaaccgagtttgatggatttagatactcaaagattcgctcagactcaaactatgcacagaaatatctcttctccatgactgattctagtaacatggcgtttgggtatgggaaatacgcctgcccagggcggttctatgcatctaatgagatgaagctgactttggcgatactccttttacaatttgagttcaagttgccagatgggaaaggaagaccacgaaatatcactattgatagtgacatgatacctgatccgagagctaggctgtgcgttaggaagcgatcactgagagatgaatga

SEQ ID NO: 59 - DNA, 1500 bp, Trametes versicolor
atggaggatcccaccgtactctacgcttgcctcgccatcgctgtcgctactttcgttgtcagatggtacagagacccgcttcggtccattcctacggttgggggctctgaccttcccatcctctcatacatcggggcgctcaggtggacccgccgcggaagagagatactgcaagaaggttatgatgggtatcgcggatccacgttcaagatcgcgatgctcgaccggtggatcgtcatcgccaacggcccaaagctcgccgacgaggtgaggaggcgtcctgacgaagagctaaacttcatggacggactgggagcgttcgtgcagacgaagtatacccttggggaagcaatccacaatgacccgtaccacgtggacattattcgtgagaagctgacgcgaggcctcccggcagtcctgccggacgtcatcgaggaactcacgctagccgttcgccagtacatcccgacggaaggagatgaatgggtcagcgtgaactgctccaaagcagcgcgggacatcgtcgcccgggcaagcaaccgcgtctttgtcgggttgcccgcttgccgcaaccagggttatctcgacctcgccattgacttcaccctgagcgttgtcaaagacagggcgatcatcaatatgttcccggagttgctgaaacctatcgtcggacgcgtggttggaaatgccactaggaacgtgcgccgcgcggtcccattcgtagcgccgttggtggaggaacgtcgccgcctcatggaggagtacggtgaggattggtcggagaaaccgaacgacatgctccagtggatcatggacgaggcagcctcgcgggactcctccgtcaaagcgatcgctgagcgtcttctcatggtcaactttgccgcaattcacacgtcgtcgaacaccatcacccacgctctttaccacctcgccgagatgccggagaccctacagccgctgcgggaagagatcgagccgctcgtcaaggaagaaggctggacgaaggccgccatgggcaagatgtggtggctcgacagcttcctgcgggagtcacagcgctacaatggcatcaacatcgtctccctgacgcgcatggccgacaaggacataacgctcagcgacggcacgttcctcccgaagggcacgctcgtcgcggtccccgcgtactcgacgcaccgcgacgacgcggtgtacgcggacgcgctggtcttcgacccgttccgcttctcccgcatgcgcgcccgcgagggcgagggcacgaagcaccagttcgtcaacacctccgtggagtacgtgcccttcggccacgggaagcacgcctgccccgggcggttcttcgcggccaacgagctgaaggcgatgctcgcgtacatcgtgctcaactacgacgtgaagctgcccggcgatggcaagcgccccctgaacatgtactggggcccgacggtcttgcctgctccggctgggcaggtgctcttccgcaagaggcaggtgtcgctgtag

SEQ ID NO: 60 - DNA, 1578 bp, Artificial Sequence
  Description of Artificial Sequence: Synthetic polynucleotide
atgggtttgttcccattagaggattcctacgcgctggtctttgaaggactagcaataacactggctttgtactatctactgtctttcatctacaaaacatctaaaaagacatgtacacctcctaaagcatctggtgaaatcattccaattacaggaatcatattgaatctgctatctggctcaagtggtctacctattatcttagcacttgcctctttagcagacagatgtggtcctattttcaccattaggctgggtattaggagagtgctagtagtatcaaattgggaaatcgctaaggagattttcactacccacgatttgatagtttctaatagaccaaaatacttagccgctaagattcttggtttcaattatgtttcattctctttcgctccatacggcccatattgggtcggaatcagaaagattattgctacaaaactaatgtcttcttccagacttcagaagttgcaatttgtaagagtttttgaactagaaaactctatgaaatctatcagagaatcatggaaggagaaaaaggatgaagagggaaaggtattagttgagatgaaaaagtggttctgggaactgaatatgaacatagtgttaaggacagttgctggtaaacaatacactggtacagttgatgatgccgatgcaaagcgtatctccgagttattcagagaatggtttcactacactggcagatttgtcgttggagacgcttttccttttctaggttggttggacctgggcggatacaaaaagacaatggaattagttgctagtagattggactcaatggtcagtaaatggttagatgagcatcgtaaaaagcaagctaacgatgacaaaaaggaggatatggatttcatggatatcatgatctccatgacagaagcaaattcaccacttgaaggatacggcactgatactattatcaagaccacatgtatgactttgattgtttcaggagttgatacaacctcaatcgtacttacttgggccttatcacttttgttaaacaacagagatactttgaaaaaggcacaagaggaattagatatgtgcgtaggtaaaggaagacaagtcaacgagtctgatcttgttaacttgatatacttggaagcagtgcttaaagaggctttaagactttacccagcagcgttcttaggcggaccaagagcattcttggaagattgtactgttgctggttatagaattccaaagggcacctgcttgttgattaacatgtggaaactgcatagagatccaaacatttggagtgatccttgcgaattcaagccagaaagatttttgacacctaatcaaaaggatgttgatgtgatcggtatggatttcgaattgataccatttggtgccggcagaagatattgtccaggtactagattggctttacagatgttgcatatcgtattagcgacattgctgcaaaacttcgaaatgtcaacaccaaacgatgcgccagtcgatatgactgcttctgttggcatgacaaatgccaaagcatcacctttagaagtcttgctatcacctcgtgttaaatggtcctaa

SEQ ID NO: 61 - DNA, 1431 bp, Artificial Sequence
  Description of Artificial Sequence: Synthetic polynucleotide
atgatacaagttttaactccaattctactcttcctcatcttcttcgttttctggaaagtctacaaacatcaaaagactaaaatcaatctaccaccaggttccttcggctggccatttttgggtgaaaccttagccttacttagagcaggctgggattctgagccagaaagattcgtaagagagcgtatcaaaaagcatggatctccacttgttttcaagacatcactatttggagacagattcgctgttctttgcggtccagctggtaataagtttttgttctgcaacgaaaacaaattagtggcatcttggtggccagtccctgtaaggaagttgttcggtaaaagtttactcacaataagaggagatgaagcaaaatggatgagaaaaatgctattgtcttacttgggtccagatgcatttgccacacattatgccgttactatggatgttgtaacacgtagacatattgatgtccattggaggggcaaggaggaagttaatgtatttcaaacagttaagttgtacgcattcgaattagcttgtagattattcatgaacctagatgacccaaaccacatcgcgaaactcggtagtcttttcaacattttcctcaaagggatcatcgagcttcctatagacgttcctggaactagattttactccagtaaaaaggccgcagctgccattagaattgaattgaaaaagctcattaaagctagaaaactcgaattgaaggagggtaaggcgtcttcttcacaggacttgctttctcatctattaacatcacctgatgagaatgggatgttcttgacagaagaggaaatagtcgataacattctacttttgttattcgctggtcacgatacctctgcactatcaataacacttttgatgaaaaccttaggtgaacacagtgatgtgtacgacaaggttttgaaggaacaattagaaatttccaaaacaaaggaggcttgggaatcactaaagtgggaagatatccagaagatgaagtactcatggtcagtaatctgtgaagtcatgagattgaatcctcctgtcatagggacatacagagaggcgttggttgatatcgactatgctggttacactatcccaaaaggatggaagttgcattggtcagctgtttctactcaaagagacgaagccaatttcgaagatgtaactagattcgatccatccagatttgaaggggcaggccctactccattcacatttgtgcctttcggtggaggtcctagaatgtgtttaggcaaagagtttgccaggttagaagtgttagcatttctccacaacattgttaccaactttaagtgggatcttctaatccctgatgagaagatcgaatatgatccaatggctactccagctaagggcttgccaattagacttcatccacaccaagtctaa

SEQ ID NO: 62 - DNA, 1578 bp, Artificial Sequence
  Description of Artificial Sequence: Synthetic polynucleotide
atggagtctttagtggttcatacagtaaatgctatctggtgtattgtaatcgtcgggattttctcagttggttatcacgtttacggtagagctgtggtcgaacaatggagaatgagaagatcactgaagctacaaggtgttaaaggcccaccaccatccatcttcaatggtaacgtctcagaaatgcaacgtatccaatccgaagctaaacactgctctggcgataacattatctcacatgattattcttcttcattattcccacacttcgatcactggagaaaacagtacggcagaatctacacatactctactggattaaagcaacacttgtacatcaatcatccagaaatggtgaaggagctatctcagactaacacattgaacttgggtagaatcacccatataaccaaaagattgaatcctatcttaggtaacggaatcataacctctaatggtcctcattgggcccatcagcgtagaattatcgcctacgagtttactcatgataagatcaagggtatggttggtttgatggttgagtctgctatgcctatgttgaataagtgggaggagatggtaaagagaggcggagaaatgggatgcgacataagagttgatgaggacttgaaagatgtttcagcagatgtgattgcaaaagcctgtttcggatcctcattttctaaaggtaaggctattttctctatgataagagatttgcttacagctatcacaaagagaagtgttctattcagattcaacggattcactgatatggtctttgggagtaaaaagcatggtgacgttgatatagacgctttagaaatggaattggaatcatccatttgggaaactgtcaaggaacgtgaaatagaatgtaaagatactcacaaaaaggatctgatgcaattgattttggaaggggcaatgcgttcatgtgacggtaacctttgggataaatcagcatatagaagatttgttgtagataattgtaaatctatctacttcgcagggcatgatagtacagctgtctcagtgtcatggtgtttgatgttactggccctaaacccatcatggcaagttaagatccgtgatgaaattctgtcttcttgcaaaaatggtattccagatgccgaaagtatcccaaaccttaaaacagtgactatggttattcaagagacaatgagattataccctccagcaccaatcgtcgggagagaagcctctaaagatatcagattgggcgatctagttgttcctaaaggcgtctgtatatggacactaataccagctttacacagagatcctgagatttggggaccagatgcaaacgatttcaaaccagaaagattttctgaaggaatttcaaaggcttgtaagtatcctcaaagttacattccatttggtctgggtcctagaacatgcgttggtaaaaactttggcatgatggaagtaaaggttcttgtttccctgattgtctccaagttctctttcactctatctcctacctaccaacatagtcctagtcacaaacttttagtagaaccacaacatggggtggtaattagagtggtttaa

SEQ ID NO: 63 - DNA, 1590 bp, Artificial Sequence
  Description of Artificial Sequence: Synthetic polynucleotide
atgtacttcctactacaatacctcaacatcacaaccgttggtgtctttgccacattgtttctctcttattgtttacttctctggagaagtagagcgggtaacaaaaagattgccccagaagctgccgctgcatggcctattatcggccacctccacttacttgcaggtggatcccatcaactaccacatattacattgggtaacatggcagataagtacggtcctgtattcacaatcagaataggcttgcatagagctgtagttgtctcatcttgggaaatggcaaaggaatgttcaacagctaatgatcaagtgtcttcttcaagacctgaactattagcttctaagttgttgggttataactacgccatgtttggtttttcaccatacggttcatactggagagaaatgagaaagatcatctctctcgaattactatctaattccagattggaactattgaaagatgttagagcctcagaagttgtcacatctattaaggaactatacaaattgtgggcggaaaagaagaatgagtcaggattggtttctgtcgagatgaaacaatggttcggagatttgactttaaacgtgatcttgagaatggtggctggtaaaagatacttctccgcgagtgacgcttcagaaaacaaacaggcccagcgttgtagaagagtcttcagagaattcttccatctctccggcttgtttgtggttgctgatgctataccttttcttggatggctcgattggggaagacacgagaagaccttgaaaaagaccgccatagaaatggattccatcgcccaggagtggcttgaggaacatagacgtagaaaagattctggagatgataattctacccaagatttcatggacgttatgcaatctgtgctagatggcaaaaatctaggcggatacgatgctgatacgattaacaaggctacatgcttaactcttatatcaggtggcagtgatactactgtagtttctttgacatgggctcttagtcttgtgttaaacaatagagatactttgaaaaaggcacaggaagagttagacatccaagtcggtaaggaaagattggttaacgagcaagacatcagtaagttagtttacttgcaagcaatagtaaaagagacactcagactttatccaccaggtcctttgggtggtttgagacaattcactgaagattgtacactaggtggctatcacgtttcaaaaggaactagattaatcatgaacttatccaagattcaaaaagatccacgtatttggtctgatcctactgaattccaaccagagagattccttacgactcataaagatgtcgatccacgtggtaaacactttgaattcattccattcggtgcaggaagacgtgcatgtcctggtatcacattcggattacaagtactacatctaacattggcatctttcttgcatgcgtttgaattttcaacaccatcaaatgagcaggttaacatgagagaatcattaggtcttacgaatatgaaatctaccccattagaagttttgatttctccaagactatcccttaattgcttcaaccttatgaaaatttga

SEQ ID NO: 64 - DNA, 1440 bp, Artificial Sequence
  Description of Artificial Sequence: Synthetic polynucleotide
atggaacctaacttttacttgtcattactattgttgttcgtgaccttcatttctttaagtctgtttttcatcttttacaaacaaaagtccccattgaatttgccaccagggaaaatgggttaccctatcataggtgaaagtttagaattcctatccacaggctggaagggacatcctgaaaagttcatatttgatagaatgcgtaagtacagtagtgagttattcaagacttctattgtaggcgaatccacagttgtttgctgtggggcagctagtaacaaattcctattctctaacgaaaacaaactggtaactgcctggtggccagattctgttaacaaaatcttcccaacaacttcactggattctaatttgaaggaggaatctataaagatgagaaagttgctgccacagttcttcaaaccagaagcacttcaaagatacgtcggcgttatggatgtaatcgcacaaagacattttgtcactcactgggacaacaaaaatgagatcacagtttatccacttgctaaaagatacactttcttgcttgcgtgtagactgttcatgtctgttgaggatgaaaatcatgtggcgaaattctcagacccattccaactaatcgctgcaggcatcatttcacttcctatcgatcttcctggtactccattcaacaaggccataaaggcttcaaatttcattagaaaagagctgataaagattatcaaacaaagacgtgttgatctggcagagggtacagcatctccaacccaggatatcttgtcacatatgctattaacatctgatgaaaacggtaaatctatgaacgagttgaacattgccgacaagattcttggactattgataggaggccacgatacagcttcagtagcttgcacatttctagtgaagtacttaggagaattaccacatatctacgataaagtctaccaagagcaaatggaaattgccaagtccaaacctgctggggaattgttgaattgggatgacttgaaaaagatgaagtattcatggaatgtggcatgtgaggtaatgagattgtcaccacctttacaaggtggttttagagaggctataactgactttatgtttaacggtttctctattccaaaagggtggaagttatactggtccgccaactctacacacaaaaatgcagaatgtttcccaatgcctgagaaattcgatcctaccagatttgaaggtaatggtccagcgccttatacatttgtaccattcggtggaggccctagaatgtgtcctggaaaggaatacgctagattagaaatcttggttttcatgcataatctggtcaaacgttttaagtgggaaaaggttattccagacgaaaagattattgtcgatccattcccaatcccagctaaagatcttccaatccgtttgtatcctcacaaagcttaa

SEQ ID NO: 65 - DNA, 1572 bp, Stevia rebaudiana
atgggtctcttccctttggaagatagttacgcactcgtctttgaaggtttagcaataactactctagctctctactacttattatccttcatctataaaacctctaaaaagacttgtactccacctaaagcaagcggtgagcaccctataacaggccacttaaaccttcttagtggttcatccggtcttccccatctagccttagcatctttggctgaccgatgtgggcccatattcaccatccgacttggcatacgtagagttttggtggttagtaattgggaaattgctaaggagatcttcactacccatgatttgattgtttcaaaccgtcccaaatacctcgctgcaaagattttgggattcaactatgtgtccttttcgtttgctccatatggcccctattgggttggaatccgtaagatcatcgccacaaaactgatgtcaagtagcaggctccagaagcttcagtttgtccgagttttcgaactagaaaactccatgaaaagcatacgcgagtcttggaaagagaaaaaagacgaagaaggtaaagtgttggtggagatgaaaaaatggttttgggaattgaatatgaatatagttcttagaactgttgctggtaaacagtacactggaactgttgatgatgcggatgcgaagaggattagtgaattgtttagagaatggtttcattacacaggaaggtttgttgtgggagatgcttttccttttcttgggtggttggatttgggtggatataagaagaccatggaactagtggcttccagactagattccatggtctcaaaatggttagacgagcatcgcaaaaagcaggctaacgacgacaaaaaagaggacatggatttcatggacatcatgatatcgatgactgaagccaattcccctttggagggttatggtacggatacaataattaaaaccacttgcatgactcttattgtcagtggtgtagatacaacctccatcgtgctaacttgggcactctcgttactactgaacaaccgtgacactcttaagaaagctcaagaagagctagacatgtgtgtgggaaaaggtcgacaagtaaacgaatcagatctagtaaacctaatctaccttgaagccgtattaaaagaagcattgcgactatacccagcagcattccttggaggtcctagagcctttttagaagactgcaccgtggcagggtaccgtatcccaaaaggcacatgtctacttattaacatgtggaaacttcatcgtgatccaaacatatggtcagacccatgtgagtttaaaccagagaggttcttaaccccaaaccaaaaggacgtagatgttattggaatggattttgagttaatcccatttggtgcgggaagaaggtattgtccagggacacgtttggcattacaaatgttacacatagttctggccactctactacaaaactttgagatgtcaactccaaatgatgcacccgttgatatgaccgcgagtgttggaatgacaaatgcgaaggcaagtccacttgaagttctactttcgccacgtgttaagtggtcatag

SEQ ID NO: 66 - DNA, 1431 bp, Stevia rebaudiana
atgattcaagttctaacaccgatccttctcttcctcattttcttcgttttctggaaggtttacaagcaccagaaaaccaaaatcaatcttccaccgggaagcttcggatggccatttctgggcgaaactctggcactcctacgtgcaggttgggactcagagccggagagatttgttcgtgaacggatcaagaaacacggaagtcctctagtgtttaagacgtcgttgtttggcgaccgttttgcggtgttgtgtggacctgccggaaacaagttcctgttctgcaacgagaacaagctggtggcgtcgtggtggccggttccggtgaggaagcttttcggcaagtctctgctcacgattcgtggtgatgaagctaagtggatgaggaagatgttgttatcgtatctcggtcctgatgctttcgcaactcattatgccgtcaccatggacgtcgtcacccgtcggcatatcgacgttcattggcgagggaaggaagaggtgaacgtattccaaaccgttaagttatatgcctttgagcttgcatgtcgtttattcatgaacctagacgacccaaaccacattgcaaaactcggttccttgttcaacattttcttgaaaggcatcattgagcttccaatcgacgtcccagggacacgattttatagctccaaaaaagcagcagcagctatcaggattgaactaaaaaaattgattaaagcaagaaaactggaactgaaagaagggaaggcatcatcttcacaagacctcttatcacatttgcttacatctccagatgaaaatggtatgtttctaaccgaagaagagattgtagacaacatcttgttactactctttgcgggtcatgatacctcggctctttcaatcactttgctcatgaagactcttggcgaacattctgatgtttatgacaaggtgttaaaagagcaactagagatatcgaagacgaaagaagcatgggagtccctgaaatgggaggacatacaaaagatgaaatactcctggagtgttatatgtgaagtcatgagactaaatccacctgttataggaacctatagagaggcccttgtggatattgattatgcgggttataccatccccaaaggatggaagctgcactggagtgctgtatcgacacaaagggacgaggctaactttgaagacgtaacacgttttgacccatcacggtttgaaggcgcaggaccgactccattcacctttgttccgtttggaggggggcctagaatgtgtttagggaaagaatttgctcgattggaagtacttgcgtttcttcacaatattgtcaccaatttcaaatgggacctgttgatacctgatgagaaaatagaatatgatcccatggctaccccagcaaaggggcttccaattcgtcttcatccccatcaagtttga

SEQ ID NO: 67 - DNA, 1578 bp, Arabidopsis thaliana
atggagagtttggttgttcatacggtaaatgcaatttggtgcatagttattgtcggaatcttcagcgtaggttatcatgtgtatggaagagcggtggtggagcagtggaggatgcggaggagtttaaagttgcaaggcgtgaagggtcctccaccgtcgatctttaacggcaatgtgtcggagatgcaacggattcagtcggaggctaaacactgttccggcgataacatcatttctcatgactattcttcttctctatttcctcatttcgatcactggcgaaaacaatacggaaggatttacacatactcaacggggttaaagcagcacctttacataaaccacccggaaatggtgaaggagcttagccaaaccaacacacttaaccttggtagaatcactcacatcaccaaacgccttaaccccattctcggcaatggcatcatcacctctaatgggcctcattgggcccatcaacgtcgtatcattgcctatgagtttacccacgacaaaatcaagggaatggttggtttaatggtggaatctgccatgccaatgttgaacaaatgggaagagatggtgaaaagaggaggagaaatgggttgtgacataagagtggacgaagaccttaaggatgtctcagctgatgtcatcgctaaggcttgctttgggagctctttttcaaaaggcaaagcaatattctctatgattagggatcttttaaccgccattactaaacgaagcgtcctcttcagattcaatggcttcactgatatggtgtttggaagtaagaagcatggtgatgtggatattgatgcgcttgagatggaattagaatcttctatatgggaaacggttaaggagagggaaattgaatgtaaggatactcacaagaaggatctaatgcagttgatactcgagggagcgatgcgaagctgcgatggtaacttgtgggacaagtcagcctatagacggtttgtggtggacaattgcaagagcatctatttcgccggacatgattcaaccgcagtctcagtgtcttggtgccttatgctcctcgctctcaatcctagttggcaggttaaaattcgcgatgaaatcttgagttcttgcaagaatggcattcccgacgcagaatcaattcctaatctcaaaacggtgacaatggtaatacaagaaacaatgagactatacccaccagcaccaatcgtgggaagagaagcatccaaagacataagacttggagaccttgtggtgccaaaaggagtgtgcatttggacactcattcctgccttacaccgagaccccgagatctggggaccagacgcaaacgacttcaagccagagaggtttagtgagggaatctctaaggcttgcaaataccctcagtcatacatcccatttggccttggaccaagaacatgcgtaggcaaaaactttggtatgatggaagtgaaagtgcttgtttcacttattgtctcaaagttcagttttactctttccccgacttatcagcactctccaagccataaactccttgtagagcctcaacatggtgttgtcattagggttgtttga

SEQ ID NO: 68 - DNA, 1590 bp, Vitis vinifera
atgtatttccttctccaatacctaaacatcaccacggtcggagtctttgccacacttttcctttcctactgtctattattatggaggtctagagctggtaacaaaaaaatagcacctgaagctgctgctgcatggcccataatcggtcacctacacctgttagctggtggttctcatcagcttccccacataaccttgggaaacatggccgacaaatatggaccggtcttcacaattcggattgggttgcatcgagctgtggtggtaagttcttgggagatggctaaagaatgctcgaccgccaatgaccaggtttcatcctcgcgtcccgaacttttagcctcaaaacttttgggctacaactacgccatgtttggtttctctccatacggttcttactggcgtgaaatgcgcaagataatcagcctagagctactctctaacagccgcttagagctgctgaaggacgtccgagcttcagaagtggtgacatccataaaagagctatacaagctctgggcagagaaaaaaaatgaatcgggccttgtctcggtggagatgaagcagtggtttggagacttgactctgaacgtaattcttaggatggtggcagggaagcgttatttcagtgcttcagatgcaagtgaaaataaacaggcgcagaggtgccggagagtgttcagggaattctttcatttgtcagggctctttgtggtggcggacgctattccatttcttggatggctcgactgggggagacatgagaaaaccctaaagaagacagcaatagaaatggacagtattgctcaagaatggttagaggagcaccgtcggaggaaagactccggtgatgataatagtacgcaagacttcatggatgtgatgcagtcagttcttgatggcaaaaaccttggtggttacgacgctgataccatcaataaagccacatgcctgactctaatctccggaggtagcgacacaactgttgtctctctaacatgggcactctctcttgtactaaacaaccgtgacaccttaaaaaaagctcaagaagaattagacatccaagttggtaaggaaagattagtgaatgaacaagatataagtaagttggtctatctccaagccattgttaaagagacattacggttatatccaccaggaccacttggaggactacgccaatttaccgaggattgcaccttgggtggataccatgtctctaaaggcacccgtttaataatgaacctttcgaagatccaaaaggatccaagaatttggtcagatccgacagaattccaaccagagaggtttctcaccacccataaagatgttgatcctcggggaaaacattttgagtttataccatttggagctggtcgaagagcatgtccaggaataacttttggtcttcaagtattacatttaacattggctagtttcttacatgcgtttgaattttcaactccatcaaatgaacaggtcaatatgcgcgagagccttggacttacaaatatgaaatctaccccacttgaagttctcatttctccacgcttatcattgaattgttttaacctaatgaagatataa

SEQ ID NO: 69 - DNA, 1440 bp, Medicago trunculata
atggagcctaatttctatctctcccttctccttctctttgtcactttcatatctctctctctttttttcatattctacaaacagaaatctccattaaatttgccacctggtaaaatgggttacccaatcataggtgaaagccttgagttcttatcaacaggatggaaaggacatcctgaaaaattcattttcgaccgtatgcgtaaatattcctcagaactctttaaaacatcaatcgtaggagaatctacggtggtttgttgcggagcagcaagtaacaagtttttgttttcaaacgagaataaacttgtgactgcatggtggccagatagtgtaaacaaaatcttccctactacttctcttgactctaacttgaaggaagaatccatcaagatgagaaaattgcttccacaattctttaaacccgaagctctacaacgttatgttggtgtcatggatgttattgctcaaagacattttgttactcattgggataataaaaatgaaatcaccgtctaccccttggccaagaggtacacctttttgttagcttgtcggttgttcatgagcgttgaagacgagaatcatgtagcaaaatttagtgatccatttcagttaattgcggccggaatcatatctctaccaattgatttgccaggaacaccattcaacaaagctataaaggcctcaaactttataagaaaggagttgattaagatcataaagcaaaggagggtagatttggcagaagggacagcatcaccaacacaagatatattgtctcacatgttgttgacaagtgatgaaaatggaaagagtatgaatgaacttaatattgctgataagattcttggccttttgatcggaggacatgacactgctagcgtcgcatgcactttccttgtcaaatatctcggcgagttacctcacatttatgataaagtctatcaagagcaaatggaaattgcaaaatcgaaaccagcaggagaattgttgaattgggatgacctgaagaaaatgaaatactcttggaacgtagcttgtgaagtaatgagactttcccctccactccaaggaggtttcagggaagccatcactgactttatgttcaatggattctcaattcctaagggatggaagctttattggagtgcaaattcaacacataagaacgcagaatgttttcccatgccagagaaatttgacccaacaagatttgaaggaaatggaccagctccttatacttttgttccctttggtggaggaccaaggatgtgtcctggaaaagagtatgcaagattagaaatacttgttttcatgcacaatttggtgaaaaggtttaagtgggaaaaggtgattccagatgagaagattattgttgatccattccccatccctgcaaaggatcttccaattcgcctttatccacacaaagcttaa

SEQ ID NO: 70 - DNA, 2133 bp, Artificial Sequence
  Description of Artificial Sequence: Synthetic polynucleotide
atgcaatcagattcagtcaaagtctctccatttgatttggtttccgctgctatgaatggcaaggcaatggaaaagttgaacgctagtgaatctgaagatccaacaacattgcctgcactaaagatgctagttgaaaatagagaattgttgacactgttcacaacttccttcgcagttcttattgggtgtcttgtatttctaatgtggagacgttcatcctctaaaaagctggtacaagatccagttccacaagttatcgttgtaaagaagaaagagaaggagtcagaggttgatgacgggaaaaagaaagtttctattttctacggcacacaaacaggaactgccgaaggttttgctaaagcattagtcgaggaagcaaaagtgagatatgaaaagacctctttcaaggttatcgatctagatgactacgctgcagatgatgatgaatatgaggaaaaactgaaaaaggaatccttagccttcttcttcttggccacatacggtgatggtgaacctactgataatgctgctaacttctacaagtggttcacagaaggcgacgataaaggtgaatggctgaaaaagttacaatacggagtatttggtttaggtaacagacaatatgaacatttcaacaagatcgctattgtagttgatgataaacttactgaaatgggagccaaaagattagtaccagtaggattaggggatgatgatcagtgtatagaagatgacttcaccgcctggaaggaattggtatggccagaattggatcaacttttaagggacgaagatgatacttctgtgactaccccatacactgcagccgtattggagtacagagtggtttaccatgataaaccagcagactcatatgctgaagatcaaacccatacaaacggtcatgttgttcatgatgcacagcatccttcaagatctaatgtggctttcaaaaaggaactacacacctctcaatcagataggtcttgtactcacttagaattcgatatttctcacacaggactgtcttacgaaactggcgatcacgttggcgtttattccgagaacttgtccgaagttgtcgatgaagcactaaaactgttagggttatcaccagacacatacttctcagtccatgctgataaggaggatgggacacctatcggtggtgcttcactaccaccaccttttcctccttgcacattgagagacgctctaaccagatacgcagatgtcttatcctcacctaaaaaggtagctttgctggcattggctgctcatgctagtgatcctagtgaagccgataggttaaagttcctggcttcaccagccggaaaagatgaatatgcacaatggatcgtcgccaaccaacgttctttgctagaagtgatgcaaagttttccatctgccaagcctccattaggtgtgttcttcgcagcagtagctccacgtttacaaccaagatactactctatcagttcatctcctaagatgtctcctaacagaatacatgttacatgtgctttggtgtacgagactactccagcaggcagaattcacagaggattgtgttcaacctggatgaaaaatgctgtccctttaacagagtcacctgattgctctcaagcatccattttcgttagaacatcaaatttcagacttccagtggatccaaaagttccagtcattatgataggaccaggcactggtcttgccccattcaggggctttcttcaagagagattggccttgaaggaatctggtacagaattgggttcttctatctttttctttggttgccgtaatagaaaagttgactttatctacgaggacgagcttaacaattttgttgagacaggagcattgtcagaattgatcgtcgcattttcaagagaagggactgccaaagagtacgttcagcacaagatgagtcaaaaagcctccgatatatggaaacttctaagtgaaggtgcctatctttatgtctgtggcgatgcaaagggcatggccaaggatgtccatagaactctgcatacaattgttcaggaacaagggagtctggattcttccaaggctgaattgtacgtcaaaaacttacagatgtctggaagatacttaagagatgtttggtaa

SEQ ID NO: 71 - DNA, 2079 bp, Artificial Sequence
  Description of Artificial Sequence: Synthetic polynucleotide
atgacttctgcactttatgcctccgatcttttcaaacaattgaaaagtatcatgggaacggattctttgtccgatgatgttgtattagttattgctacaacttctctggcactggttgctggtttcgttgtcttattgtggaaaaagaccacggcagatcgttccggcgagctaaagccactaatgatccctaagtctctgatggcgaaagatgaggatgatgacttagatctaggttctggaaaaacgagagtctctatcttcttcggcacacaaaccggaacagccgaaggattcgctaaagcactttcagaagagatcaaagcaagatacgaaaaggcggctgtaaaagtaatcgatttggatgattacgctgccgatgatgaccaatatgaggaaaagttgaaaaaggaaacattggctttcttttgtgtagccacgtatggtgatggtgaaccaaccgataacgccgcaagattctacaagtggtttactgaagagaacgaaagagatatcaagttgcagcaacttgcttacggcgtttttgccttaggtaacagacaatacgagcactttaacaagataggtattgtcttagatgaagagttatgcaaaaagggtgcgaagagattgattgaagtcggtttaggagatgatgatcaatctatcgaggatgactttaatgcatggaaggaatctttgtggtctgaattagataagttacttaaggacgaagatgataaatccgttgccactccatacacagccgtcattccagaatatagagtagttactcatgatccaagattcacaacacagaaatcaatggaaagtaatgtggctaatggtaatactaccatcgatattcatcatccatgtagagtagacgttgcagttcaaaaggaattgcacactcatgaatcagacagatcttgcatacatcttgaatttgatatatcacgtactggtatcacttacgaaacaggtgatcacgtgggtgtctacgctgaaaaccatgttgaaattgtagaggaagctggaaagttgttgggccatagtttagatcttgttttctcaattcatgccgataaagaggatggctcaccactagaaagtgcagtgcctccaccatttccaggaccatgcaccctaggtaccggtttagctcgttacgcggatctgttaaatcctccacgtaaatcagctctagtggccttggctgcgtacgccacagaaccttctgaggcagaaaaactgaaacatctaacttcaccagatggtaaggatgaatactcacaatggatagtagctagtcaacgttctttactagaagttatggctgctttcccatccgctaaacctcctttgggtgttttcttcgccgcaatagcgcctagactgcaaccaagatactattcaatttcatcctcacctagactggcaccatcaagagttcatgtcacatccgctttagtgtacggtccaactcctactggtagaatccataagggcgtttgttcaacatggatgaaaaacgcggttccagcagagaagtctcacgaatgttctggtgctccaatctttatcagagcctccaacttcaaactgccttccaatccttctactcctattgtcatggtcggtcctggtacaggtcttgctccattcagaggtttcttacaagagagaatggccttaaaggaggatggtgaagagttgggatcttctttgttgtttttcggctgtagaaacagacaaatggatttcatctacgaagatgaactgaataactttgtagatcaaggagttatttcagagttgataatggctttttctagagaaggtgctcagaaggagtacgtccaacacaaaatgatggaaaaggccgcacaagtttgggacttaatcaaagaggaaggctatctatatgtctgtggtgatgcaaagggtatggcaagagatgttcacagaacacttcatactatagtccaggaacaggaaggcgttagttcttctgaagcggaagcaattgtgaaaaagttacaaacagagggaagatacttgagagatgtgtggtaa

SEQ ID NO: 72 - DNA, 2142 bp, Artificial Sequence
  Description of Artificial Sequence: Synthetic polynucleotide
atggcagaattagatacacttgatatagtagtattaggtgttatctttttgggtactgtggcatactttactaagggtaaattgtggggtgttaccaaggatccatacgctaacggattcgctgcaggtggtgcttccaagcctggcagaactagaaacatcgtcgaagctatggaggaatcaggtaaaaactgtgttgttttctacggcagtcaaacaggtacagcggaggattacgcatcaagacttgcaaaggaaggaaagtccagattcggtttgaacactatgatcgccgatctagaagattatgacttcgataacttagacactgttccatctgataacatcgttatgtttgtattggctacttacggtgaaggcgaaccaacagataacgccgtggatttctatgagttcattactggcgaagatgcctctttcaatgagggcaacgatcctccactaggtaacttgaattacgttgcgttcggtctgggcaacaatacctacgaacactacaactcaatggtcaggaacgttaacaaggctctagaaaagttaggagctcatagaattggagaagcaggtgagggtgacgacggagctggaactatggaagaggactttttagcttggaaagatccaatgtgggaagccttggctaaaaagatgggcttggaggaaagagaagctgtatatgaacctattttcgctatcaatgagagagatgatttgacccctgaagcgaatgaggtatacttgggagaacctaataagctacacttggaaggtacagcgaaaggtccattcaactcccacaacccatatatcgcaccaattgcagaatcatacgaacttttctcagctaaggatagaaattgtctgcatatggaaattgatatttctggtagtaatctaaagtatgaaacaggcgaccatatcgcgatctggcctaccaacccaggtgaagaggtcaacaaatttcttgacattctagatctgtctggtaagcaacattccgtcgtaacagtgaaagccttagaacctacagccaaagttccttttccaaatccaactacctacgatgctatattgagataccatctggaaatatgcgctccagtttctagacagtttgtctcaactttagcagcattcgcccctaatgatgatatcaaagctgagatgaaccgtttgggatcagacaaagattacttccacgaaaagacaggaccacattactacaatatcgctagatttttggcctcagtctctaaaggtgaaaaatggacaaagataccattttctgctttcatagaaggccttacaaaactacaaccaagatactattctatctcttcctctagtttagttcagcctaaaaagattagtattactgctgttgtcgaatctcagcaaattccaggtagagatgacccattcagaggtgtagcgactaactacttgttcgctttgaagcagaaacaaaacggtgatccaaatccagctccttttggccaatcatacgagttgacaggaccaaggaataagtatgatggtatacatgttccagtccatgtaagacattctaactttaagctaccatctgatccaggcaaacctattatcatgatcggtccaggtaccggtgttgccccttttagaggcttcgtccaagagagggcaaaacaagccagagatggtgtagaagttggtaaaacactgctgttctttggatgtagaaagagtacagaagatttcatgtatcaaaaagagtggcaagagtacaaggaagctcttggcgacaaattcgaaatgattacagctttttcaagagaaggatctaaaaaggtttatgttcaacacagactgaaggaaagatcaaaggaagtttctgatcttctatcccaaaaagcatacttctacgtttgcggagacgccgcacatatggcacgtgaagtgaacactgtgttagcacagatcatagcagaaggccgtggtgtatcagaagccaagggtgaggaaattgtcaaaaacatgagatcagcaaatcaataccaagtgtgttctgatttcgtaactttacactgtaaagagacaacatacgcgaattcagaattgcaagaggatgtctggagttaa

SEQ ID NO: 73 - DNA, 2133 bp, Stevia rebaudiana
atgcaatcagattccgtaaaagtgtcgccgttcgatctcgtatctgcagctatgaacggaaaagcaatggagaaattgaacgcatcggaatcggaagatccgacgacgctaccggcgttgaagatgctggtggagaatcgcgagctgctgacactgtttacgacgtcgtttgctgtattgatcggatgtctcgtgtttttgatgtggcggagatcgtcctcgaagaaactggttcaggatccggtgccgcaggtaatcgttgttaagaagaaagagaaggagtctgaggttgatgatggcaagaagaaagtttcgatattctacggaactcaaacaggaaccgctgaaggttttgccaaggcacttgtagaggaagctaaagttcgatatgaaaagacatcctttaaagttattgatctggatgattatgctgctgatgacgatgagtatgaggagaagcttaagaaagaatctttggcgtttttctttttggcaacgtatggagatggtgaaccaacagataatgcagccaatttttacaaatggtttacagagggagatgacaaaggcgaatggctgaagaaacttcaatatggcgtgtttggcctcggtaacagacaatatgagcatttcaataagattgcaatagtggttgatgacaaactcacagaaatgggcgcaaaacgccttgttcctgtgggtcttggagatgacgatcaatgtatagaagatgactttacagcatggaaagagttagtgtggcccgagttggatcaattgttgcgtgatgaggatgacacgagtgttacgactccttacactgctgcggttttggaataccgagttgtatatcatgataaacctgcagactcgtatgcagaagatcaaactcatacaaatggtcatgttgttcatgatgctcaacatccatctagatccaatgtggcatttaaaaaggaattgcacacctctcaatctgaccggtcttgcactcatttggaatttgatatctctcacaccgggctatcatacgagacgggggatcatgttggtgtctacagtgagaatctaagtgaagttgtagatgaagctttaaaattactcggtttgtcacccgacacttatttctcagtccatgctgacaaggaagacggaacacctattggcggcgcctccttgccgccacctttccctccatgcactttaagagatgcattaacgcgctacgcagatgttttgagttctcctaaaaaggttgctttgcttgctctggctgctcatgcttctgatcctagcgaagccgatcgattaaaatttctagcatctccggctggcaaggatgaatatgctcaatggatagttgcaaaccaaagaagtcttcttgaagttatgcagtcatttccgtcagctaaaccgccacttggtgttttcttcgcagctgtcgccccacgtttacaacctcgatattactcgatttcttcttctccaaagatgtcaccaaacagaattcatgtgacttgtgcattagtttatgagacaacacctgcaggacgtattcacagaggattgtgttcaacatggatgaagaatgctgtgcctttgaccgaaagtccagattgtagtcaggcgtcgatttttgttagaacgtctaacttccgacttccggttgacccgaaagtcccggtcatcatgatcggtcccgggactgggttagcccctttcagaggttttcttcaagaacggttagctttgaaggaatctggaaccgaactcgggtcatctattttctttttcggatgcagaaaccgcaaagtggattttatatacgaagacgaactaaacaactttgtggagaccggtgctttatcggagcttattgttgcattctcccgtgaaggaaccgcaaaggagtatgtgcaacataaaatgagccagaaggcttcagatatctggaagttgctttcagagggagcatatttatatgtatgtggtgatgctaaaggcatggctaaagatgtacacagaacccttcacacaattgtacaagaacagggatctctagattcttccaaggcagaattgtatgtaaagaacctacaaatgtcgggaagatatcttcgtgatgtttggtaa

SEQ ID NO: 74 - DNA, 2079 bp, Arabidopsis thaliana
atgacttctgctttgtatgcttccgatttgtttaagcagctcaagtcaattatggggacagattcgttatccgacgatgttgtacttgtgattgcaacgacgtctttggcactagtagctggatttgtggtgttgttatggaagaaaacgacggcggatcggagcggggagctgaagcctttgatgatccctaagtctcttatggctaaggacgaggatgatgatttggatttgggatccgggaagactagagtctctatcttcttcggtacgcagactggaacagctgagggatttgctaaggcattatccgaagaaatcaaagcgagatatgaaaaagcagcagtcaaagtcattgacttggatgactatgctgccgatgatgaccagtatgaagagaaattgaagaaggaaactttggcatttttctgtgttgctacttatggagatggagagcctactgacaatgctgccagattttacaaatggtttacggaggaaaatgaacgggatataaagcttcaacaactagcatatggtgtgtttgctcttggtaatcgccaatatgaacattttaataagatcgggatagttcttgatgaagagttatgtaagaaaggtgcaaagcgtcttattgaagtcggtctaggagatgatgatcagagcattgaggatgattttaatgcctggaaagaatcactatggtctgagctagacaagctcctcaaagacgaggatgataaaagtgtggcaactccttatacagctgttattcctgaataccgggtggtgactcatgatcctcggtttacaactcaaaaatcaatggaatcaaatgtggccaatggaaatactactattgacattcatcatccctgcagagttgatgttgctgtgcagaaggagcttcacacacatgaatctgatcggtcttgcattcatctcgagttcgacatatccaggacgggtattacatatgaaacaggtgaccatgtaggtgtatatgctgaaaatcatgttgaaatagttgaagaagctggaaaattgcttggccactctttagatttagtattttccatacatgctgacaaggaagatggctccccattggaaagcgcagtgccgcctcctttccctggtccatgcacacttgggactggtttggcaagatacgcagaccttttgaaccctcctcgaaagtctgcgttagttgccttggcggcctatgccactgaaccaagtgaagccgagaaacttaagcacctgacatcacctgatggaaaggatgagtactcacaatggattgttgcaagtcagagaagtcttttagaggtgatggctgcttttccatctgcaaaacccccactaggtgtattttttgctgcaatagctcctcgtctacaacctcgttactactccatctcatcctcgccaagattggcgccaagtagagttcatgttacatccgcactagtatatggtccaactcctactggtagaatccacaagggtgtgtgttctacgtggatgaagaatgcagttcctgcggagaaaagtcatgaatgtagtggagccccaatctttattcgagcatctaatttcaagttaccatccaacccttcaactccaatcgttatggtgggacctgggactgggctggcaccttttagaggttttctgcaggaaaggatggcactaaaagaagatggagaagaactaggttcatctttgctcttctttgggtgtagaaatcgacagatggactttatatacgaggatgagctcaataattttgttgatcaaggcgtaatatctgagctcatcatggcattctcccgtgaaggagctcagaaggagtatgttcaacataagatgatggagaaggcagcacaagtttgggatctaataaaggaagaaggatatctctatgtatgcggtgatgctaagggcatggcgagggacgtccaccgaactctacacaccattgttcaggagcaggaaggtgtgagttcgtcagaggcagaggctatagttaagaaacttcaaaccgaaggaagatacctcagagatgtctggtga

SEQ ID NO: 75 - DNA, 2142 bp, Giberella fujikuroi
atggctgaactcgacactctggacatcgtcgtcctcggcgttatcttcctcggaacggttgcatactttacaaagggcaagctatggggtgttaccaaggatccctacgcgaatggcttcgctgccggcggcgcttctaagccgggtcgcacgaggaacatcgtcgaggcaatggaagaatccggcaagaactgtgttgtcttctatggttctcagaccggtactgctgaagattatgcttctcgcctcgccaaggagggtaagagtcgattcggactaaacaccatgattgccgatcttgaggactacgatttcgacaacctggataccgttcccagtgacaacattgtcatgttcgttctcgcaacttatggtgaaggtgagcctaccgataacgcggtcgacttctatgaattcattaccggcgaggatgccagcttcaatgagggcaatgatcctccgctgggcaacctcaactacgttgctttcggtctcggaaacaacacgtacgagcactacaactctatggtccgcaatgttaacaaggctctcgagaagcttggcgctcaccgcatcggtgaagctggtgagggtgatgatggtgctggtaccatggaagaggacttcttggcctggaaggatcccatgtgggaagccctcgctaagaaaatgggactggaagagcgtgaagcagtctacgagcctatttttgccattaacgaacgcgacgacctgactcctgaagccaatgaagtgtatctcggtgagcccaacaagctgcatctcgaaggcaccgccaagggaccattcaactctcacaacccctacattgcccctatcgctgaatcttatgagttgttctccgccaaggacagaaactgcctccacatggaaattgacatcagcggttctaacctcaagtacgaaactggagaccatattgctatctggcctaccaaccctggtgaggaggtcaacaaattcctggatattctcgacctctctggaaagcagcacagcgttgtcactgtcaaggctctcgagcctaccgccaaggttcctttccccaaccctacaacctacgatgccattctgcgataccacctcgagatctgcgctcctgtttcacgtcaattcgtctctactctcgccgcatttgctcccaacgatgatatcaaggctgagatgaaccgccttggcagcgataaggattatttccacgagaagactggcccgcattactacaacattgcccgtttccttgccagcgtcagcaagggcgagaagtggaccaaaatcccgttctctgccttcatcgagggtctcaccaagctccagccccgttactactccatttcttcctcgtctctggttcagcccaagaaaatctcgatcactgccgtcgttgaatcccagcagattcctggccgggatgatcctttccgtggtgttgctacaaactatctttttgccctaaagcaaaagcagaacggtgaccccaaccctgcaccttttggtcagagctacgagcttacaggcccccgcaataagtatgatggcatccacgttcctgtccatgttcgtcactccaacttcaagctcccctcggaccccggtaagcccatcatcatgattggtcctggtactggtgtcgctcccttccgcggtttcgtgcaggagcgtgctaagcaagcccgtgatggtgttgaggttggaaagacactcttgttctttggttgccgaaagtcaaccgaggatttcatgtaccaaaaggagtggcaggaatacaaggaggctcttggcgataagtttgaaatgatcaccgccttttctcgagagggctccaagaaggtttatgttcagcaccgacttaaggagcgatctaaggaggtcagcgatctgctctcccagaaggcttatttctatgtctgcggtgatgcagcccacatggcccgcgaggtcaataccgtcttggcacaaatcattgccgagggacgtggggtgtctgaggccaagggcgaggagatcgtgaagaacatgagatcagcgaaccaataccaggtatgtagtgactttgttactcttcactgcaaagaaaccacatatgctaactcagaattacaggaggatgtttggtcatag

SEQ ID NO: 76 - protein, 459 aa, Ipomoea purpurea
MGSQATTYHMAMYPWFGVGHLTGFFRLANKLAGKGHRISFLIPKNTQSKLESFNLHPHLISFVPIVVPSIPGLPPGAETTSDVPFPSTHLLMEAMDKTQNDIEIILKDLKVDVVFYDFTHWLPSLARKIGIKSVFYSTISPLMHGYALSPERRVVGKQLTEADMMKAPASFPDPSIKLHAHEARGFTARTVMKFGGDITFFDRIFTAVSESDGLAYSTCREIEGQFCDYIETQFQKPVLLAGPALPVPSKSTMEQKWSDWLGKFKEGSVIYCAFGSECTLRKDKFQELLWGLELTGMPFFAALKPPFETESVEAAIPEELKEKIQGRGIVHGEWVQQQLFLQHPSVGCFVSHCGWASLSEALVNDCQIVLLPQVGDQIINARIMSVSLKVGVEVEKGEEDGVFSRESVCKAVKAVMDEKSEIGREVRGNHDKLRGFLMNADLDSKYMDSFNQKLQDLLG

SEQ ID NO: 77 - DNA, 1380 bp, Ipomoea purpurea
atgggttctcaagctacaacttaccatatggccatgtatccatggtttggggttggacatttgactggtttcttccgtttggcaaacaaattagctggcaaaggacatagaatctcatttctaattcctaaaaacactcaatctaagttagaatctttcaaccttcatccacacttaatctcttttgtgcctatcgttgtcccaagtataccaggcctgccacctggtgcagagactacatcagatgttcctttcccaagtacacatttgctaatggaagcaatggacaagactcaaaacgatatagagattatcctgaaggatcttaaagtagatgttgttttctatgattttactcactggttgccttctctggccagaaagattggcattaagagtgtcttttactccaccatttctcctttaatgcatggatatgctttatcaccagaaagacgtgtagttggtaagcaattgacagaggcagatatgatgaaggccccagcttctttcccagacccatccattaagctacatgcacatgaagctaggggttttacagccagaaccgttatgaaattcggtggtgacatcacctttttcgatagaatattcacagcagtttccgaaagtgatggcctggcctactctacttgtagagagatcgagggacaattctgtgattacattgaaacacaattccagaagccagtcttgttagccggtccagctttgccagtcccatccaaatccactatggaacaaaagtggtcagattggttggggaaattcaaggaaggctccgtcatctactgtgctttcgggtctgaatgtacattgagaaaggacaaatttcaggaacttttatggggtttggaattgacaggaatgcctttcttcgctgctctgaagccaccttttgagactgagtctgttgaggctgctatccctgaggaactaaaggaaaagattcagggaagaggtatagtacatggagaatgggtacaacaacaattgtttcttcaacacccatctgtcgggtgcttcgtttctcactgcggctgggcaagtttatctgaagcccttgttaatgattgtcaaatcgtgttacttccacaagttggcgatcagattatcaacgccagaataatgtcagtatcacttaaagtgggcgtggaagttgaaaagggtgaggaggacggtgtcttttcaagagaatctgtgtgcaaggctgttaaagcagtaatggatgaaaaatctgaaatcggtagagaagtcagaggtaatcatgataaactgaggggtttcttgatgaatgcagacttagattcaaagtacatggattcattcaatcaaaagctacaagatttgctaggttaa

SEQ ID NO: 78 - protein, 438 aa, Bellis perennis
MDSKIDSKTFRVVMLPWLAYSHISSFLVFAKRLTNHNFHIYICSSQTNMQYLKNNLTSQYSKSIQLIELNLPSSSELPLQYHTTHGLPPHLTKTLSDDYQKSGPDFETILIKLNPHLVIYDFNQLWAPEVASTLHIPSIQLLSGCVALYALDAHLYTKPLDENLAKFPFPEIYPKNRDIPKGGSKYIERFVDCMRRSCEIILVRSTMELEGKYIDYLSKTLGKKVLPVGPLVQEASLLQDDHIWIMKWLDKKEESSVVFVCFGSEYILSDNEIEDIAYGLELSQVSFVWAIRAKTSALNGFIDRVGDKGLVIDKWVPQANILSHSSTGGFISHCGWSSTMESIRYGVPIIAMPMQFDQPYNARLMETVGAGIEVGRDGEGRLKREEIAAVVRKVVVEDSGESIREKAKELGEIMKKNMEAEVDGIVIENLVKLCEMNN

SEQ ID NO: 79 - DNA, 1317 bp, Bellis perennis
atggattctaaaatcgattcaaagacattcagagtcgttatgttgccttggcttgcatactcacacatttcatcattcctagtgtttgccaagagactaacaaatcataacttccacatctacatttgttcctctcaaacaaatatgcaatacctgaaaaacaacttgacgtctcagtattcaaaatctatacaactgattgagttgaatcttccatctagttccgaattgcctctgcagtatcatactactcacggactaccaccacaccttacgaaaacattgtctgatgattatcaaaagtccggacctgactttgaaaccattttgatcaaattgaacccacatctggtaatctacgactttaatcaactttgggctccagaggttgctagtacacttcatattccatccatacagttactgtctggttgcgtcgccttatatgccttagacgcccatctgtacacaaagccactagacgaaaacttggctaagtttcctttcccagaaatctatcctaaaaacagagatattcctaagggaggtagtaaatacatcgaaaggttcgtagactgtatgagaagatcttgtgaaatcatattagtcagaagtaccatggaacttgaaggaaaatacattgattacttgtctaagacattagggaaaaaggtgttgccagtagggcctctggtgcaagaggcttctttgttgcaagatgatcatatatggattatgaagtggttagacaaaaaggaggagtcatccgtcgtgtttgtttgttttggttctgagtacatcttatcagacaacgaaatagaagatattgcttatggcctagagttgtcccaagtaagtttcgtttgggcaataagagctaagacttctgccttaaatggcttcattgatagagtgggtgataaaggcttagtcatcgataaatgggttccacaggctaacatcttatctcactcttctactggtggattcattagtcattgcggttggtcatcaacaatggaatctattagatatggggttcctattatcgccatgccaatgcaattcgatcaaccttacaatgctaggttgatggaaactgttggtgcaggtatcgaagttggcagagatggcgaaggtagattgaaaagagaagagattgctgccgtggttagaaaggtcgttgttgaagattctggggaatccataagggagaaggcaaaggaattgggagaaatcatgaaaaaaaacatggaggccgaagtagatggtatagtgattgaaaatctagttaagctatgtgagatgaacaattaa

SEQ ID NO: 80 - DNA, 2490 bp, Zea mays
atggttttgtcttcttcttgtactacagtaccacacttatcttcattagctgtcgtgcaacttggtccttggagcagtaggattaaaaagaaaaccgatactgttgcagtaccagccgctgcaggaaggtggagaagggccttggctagagcacagcacacatcagaatccgcagctgtcgcaaagggcagcagtttgacccctatagtgagaactgacgctgagtcaaggagaacaagatggccaaccgatgacgatgacgccgaacctttagtggatgagatcagggcaatgcttacttccatgtctgatggtgacatttccgtgagcgcatacgatacagcctgggtcggattggttccaagattagacggcggtgaaggtcctcaatttccagcagctgtgagatggataagaaataaccagttgcctgacggaagttggggcgatgccgcattattctctgcctatgacaggcttatcaatacccttgcctgcgttgtaactttgacaaggtggtccctagaaccagagatgagaggtagaggactatcttttttgggtaggaacatgtggaaattagcaactgaagatgaagagtcaatgcctattggcttcgaattagcatttccatctttgatagagcttgctaagagcctaggtgtccatgacttcccttatgatcaccaggccctacaaggaatctactcttcaagagagatcaaaatgaagaggattccaaaagaagtgatgcataccgttccaacatcaatattgcacagtttggagggtatgcctggcctagattgggctaaactacttaaactacagagcagcgacggaagttttttgttctcaccagctgccactgcatatgctttaatgaataccggagatgacaggtgttttagctacatcgatagaacagtaaagaaattcaacggcggcgtccctaatgtttatccagtggatctatttgaacatatttgggccgttgatagacttgaaagattaggaatctccaggtacttccaaaaggagatcgaacaatgcatggattatgtaaacaggcattggactgaggacggtatttgttgggcaaggaactctgatgtcaaagaggtggacgacacagctatggcctttagacttcttaggttgcacggctacagcgtcagtcctgatgtgtttaaaaacttcgaaaaggacggtgaatttttcgcatttgtcggacagtctaatcaagctgttaccggtatgtacaacttaaacagagcaagccagatatccttcccaggcgaggatgtgcttcatagagctggtgccttctcatatgagttcttgaggagaaaagaagcagagggagctttgagggacaagtggatcatttctaaagatctacctggtgaagttgtgtatactttggattttccatggtacggcaacttacctagagtcgaggccagagactacctagagcaatacggaggtggtgatgacgtttggattggcaagacattgtataggatgccacttgtaaacaatgatgtatatttggaattggcaagaatggatttcaaccactgccaggctttgcatcagttagagtggcaaggactaaaaagatggtatactgaaaataggttgatggactttggtgtcgcccaagaagatgcccttagagcttattttcttgcagccgcatctgtttacgagccttgtagagctgccgagaggcttgcatgggctagagccgcaatactagctaacgccgtgagcacccacttaagaaatagcccatcattcagagaaaggttagagcattctcttaggtgtagacctagtgaagagacagatggctcctggtttaactcctcaagtggctctgatgcagttttagtaaaggctgtcttaagacttactgattcattagccagggaagcacagccaatccatggaggtgacccagaagatattatacacaagttgttaagatctgcttgggccgagtgggttagggaaaaggcagacgctgccgatagcgtgtgcaatggtagttctgcagtagaacaagagggatcaagaatggtccatgataaacagacctgtctattattggctagaatgatcgaaatttctgccggtagggcagctggtgaagcagccagtgaggacggcgatagaagaataattcaattaacaggctccatctgcgacagtcttaagcaaaaaatgctagtttcacaggaccctgaaaaaaatgaagagatgatgtctcacgtggatgacgaattgaagttgaggattagagagttcgttcaatatttgcttagactaggtgaaaaaaagactggatctagcgaaaccaggcaaacatttttaagtatagtgaaatcatgttactatgctgctcattgcccacctcatgtcgttgatagacacattagtagagtgattttcgagccagtaagtgccgcaaagtaaccgcgg

SEQ ID NO: 81 - protein, 827 aa, Zea mays
MVLSSSCTTVPHLSSLAVVQLGPWSSRIKKKTDTVAVPAAAGRWRRALARAQHTSESAAVAKGSSLTPIVRTDAESRRTRWPTDDDDAEPLVDEIRAMLTSMSDGDISVSAYDTAWVGLVPRLDGGEGPQFPAAVRWIRNNQLPDGSWGDAALFSAYDRLINTLACVVTLTRWSLEPEMRGRGLSFLGRNMWKLATEDEESMPIGFELAFPSLIELAKSLGVHDFPYDHQALQGIYSSREIKMKRIPKEVMHTVPTSILHSLEGMPGLDWAKLLKLQSSDGSFLFSPAATAYALMNTGDDRCFSYIDRTVKKFNGGVPNVYPVDLFEHIWAVDRLERLGISRYFQKEIEQCMDYVNRHWTEDGICWARNSDVKEVDDTAMAFRLLRLHGYSVSPDVFKNFEKDGEFFAFVGQSNQAVTGMYNLNRASQISFPGEDVLHRAGAFSYEFLRRKEAEGALRDKWIISKDLPGEVVYTLDFPWYGNLPRVEARDYLEQYGGGDDVWIGKTLYRMPLVNNDVYLELARMDFNHCQALHQLEWQGLKRWYTENRLMDFGVAQEDALRAYFLAAASVYEPCRAAERLAWARAAILANAVSTHLRNSPSFRERLEHSLRCRPSEETDGSWFNSSSGSDAVLVKAVLRLTDSLAREAQPIHGGDPEDIIHKLLRSAWAEWVREKADAADSVCNGSSAVEQEGSRMVHDKQTCLLLARMIEISAGRAAGEAASEDGDRRIIQLTGSICDSLKQKMLVSQDPEKNEEMMSHVDDELKLRIREFVQYLLRLGEKKTGSSETRQTFLSIVKSCYYAAHCPPHVVDRHISRVIFEPVSAAK

SEQ ID NO: 82 - DNA, 1461 bp, Artificial Sequence
  Description of Artificial Sequence: Synthetic polynucleotide
actagtaaaatggatgcaatggcaactactgagaaaaagcctcatgtgatcttcattccatttcctgcacaatctcacataaaggcaatgctaaagttagcacaactattacaccataagggattacagataactttcgtgaataccgacttcatccataatcaatttctggaatctagtggccctcattgtttggacggagccccagggtttagattcgaaacaattcctgacggtgtttcacattccccagaggcctccatcccaataagagagagtttactgaggtcaatagaaaccaactttttggatcgtttcattgacttggtcacaaaacttccagacccaccaacttgcataatctctgatggctttctgtcagtgtttactatcgacgctgccaaaaagttgggtatcccagttatgatgtactggactcttgctgcatgcggtttcatgggtttctatcacatccattctcttatcgaaaagggttttgctccactgaaagatgcatcatacttaaccaacggctacctggatactgttattgactgggtaccaggtatggaaggtataagacttaaagattttcctttggattggtctacagaccttaatgataaagtattgatgtttactacagaagctccacaaagatctcataaggtttcacatcatatctttcacacctttgatgaattggaaccatcaatcatcaaaaccttgtctctaagatacaatcatatctacactattggtccattacaattacttctagatcaaattcctgaagagaaaaagcaaactggtattacatccttacacggctactctttagtgaaagaggaaccagaatgttttcaatggctacaaagtaaagagcctaattctgtggtctacgtcaacttcggaagtacaacagtcatgtccttggaagatatgactgaatttggttggggccttgctaattcaaatcattactttctatggattatcaggtccaatttggtaataggggaaaacgccgtattacctccagaattggaggaacacatcaaaaagagaggtttcattgcttcctggtgttctcaggaaaaggtattgaaacatccttctgttggtggtttccttactcattgcggttggggctctacaatcgaatcactaagtgcaggagttccaatgatttgttggccatattcatgggaccaacttacaaattgtaggtatatctgtaaagagtgggaagttggattagaaatgggaacaaaggttaaacgtgatgaagtgaaaagattggttcaggagttgatgggggaaggtggccacaagatgagaaacaaggccaaagattggaaggaaaaagccagaattgctattgctcctaacgggtcatcctctctaaacattgataagatggtcaaagagattacagtcttagccagaaactaagtcgac

SEQ ID NO: 83 - DNA, 1398 bp, Artificial Sequence
  Description of Artificial Sequence: Synthetic polynucleotide
actagtaaaatggcagagcaacaaaagatcaaaaagtcacctcacgtcttacttattccatttcctctgcaaggacatatcaacccattcatacaatttgggaaaagattgattagtaagggtgtaaagacaacactggtaaccactatccacactttgaattctactctgaaccactcaaatactactactacaagtatagaaattcaagctatatcagacggatgcgatgagggtggctttatgtctgccggtgaatcttacttggaaacattcaagcaagtgggatccaagtctctggccgatctaatcaaaaagttacagagtgaaggcaccacaattgacgccataatctacgattctatgacagagtgggttttagacgttgctatcgaatttggtattgatggaggttcctttttcacacaagcatgtgttgtgaattctctatactaccatgtgcataaagggttaatctctttaccattgggtgaaactgtttcagttccaggttttccagtgttacaacgttgggaaaccccattgatcttacaaaatcatgaacaaatacaatcaccttggtcccagatgttgtttggtcaattcgctaacatcgatcaagcaagatgggtctttactaattcattctataagttagaggaagaggtaattgaatggactaggaagatctggaatttgaaagtcattggtccaacattgccatcaatgtatttggacaaaagacttgatgatgataaagataatggtttcaatttgtacaaggctaatcatcacgaatgtatgaattggctggatgacaaaccaaaggaatcagttgtatatgttgctttcggctctcttgttaaacatggtccagaacaagttgaggagattacaagagcacttatagactctgacgtaaactttttgtgggtcattaagcacaaagaggaggggaaactgccagaaaacctttctgaagtgataaagaccggaaaaggtctaatcgttgcttggtgtaaacaattggatgttttagctcatgaatctgtaggctgttttgtaacacattgcggattcaactctacactagaagccatttccttaggcgtacctgtcgttgcaatgcctcagttctccgatcagacaaccaacgctaaacttttggacgaaatactaggggtgggtgtcagagttaaagcagacgagaatggtatcgtcagaagagggaacctagcttcatgtatcaaaatgatcatggaagaggaaagaggagttatcataaggaaaaacgcagttaagtggaaggatcttgcaaaggttgccgtccatgaaggcggctcttcagataatgatattgttgaatttgtgtccgaactaatcaaagcctaagtcgac

SEQ ID NO: 84 - DNA, 1437 bp, Artificial Sequence
  Description of Artificial Sequence: Synthetic polynucleotide
actagtaaaatggctacatctgattctattgttgatgacaggaagcagttgcatgtggctactttcccttggcttgctttcggtcatatactgccttacctacaactatcaaaactgatagctgaaaaaggacataaagtgtcattcctttcaacaactagaaacattcaaagattatcttcccacatatcaccattgattaacgtcgttcaattgacacttccaagagtacaggaattaccagaagatgctgaagctacaacagatgtgcatcctgaagatatcccttacttgaaaaaggcatccgatggattacagcctgaggtcactagattccttgagcaacacagtccagattggatcatatacgactacactcactattggttgccttcaattgcagcatcactaggcatttctagggcacatttcagtgtaaccacaccttgggccattgcttacatgggtccatccgctgatgctatgattaacggcagtgatggtagaactaccgttgaagatttgacaaccccaccaaagtggtttccatttccaactaaagtctgttggagaaaacacgacttagcaagactggttccatacaaggcaccaggaatctcagacggctatagaatgggtttagtccttaaagggtctgactgcctattgtctaagtgttaccatgagtttgggacacaatggctaccacttttggaaacattacaccaagttcctgtcgtaccagttggtctattacctccagaaatccctggtgatgagaaggacgagacttgggtttcaatcaaaaagtggttagacgggaagcaaaaaggctcagtggtatatgtggcactgggttccgaagttttagtatctcaaacagaagttgtggaacttgccttaggtttggaactatctggattgccatttgtctgggcctacagaaaaccaaaaggccctgcaaagtccgattcagttgaattgccagacggctttgtcgagagaactagagatagagggttggtatggacttcatgggctccacaattgagaatcctgagtcacgaatctgtgtgcggtttcctaacacattgtggttctggttctatagttgaaggactgatgtttggtcatccacttatcatgttgccaatctttggtgaccagcctttgaatgcacgtctgttagaagataaacaagttggaattgaaatcccacgtaatgaggaagatggatgtttaaccaaggagtctgtggccagatcattacgttccgttgtcgttgaaaaggaaggcgaaatctacaaggccaatgcccgtgaactttcaaagatctacaatgacacaaaagtagagaaggaatatgtttctcaatttgtagattacctagagaaaaacgctagagccgtagctattgatcatgaatcctaagtcgac

SEQ ID NO: 85 - DNA, 1392 bp, Artificial Sequence
  Description of Artificial Sequence: Synthetic polynucleotide
actagtaaaatggaaaacaagaccgaaacaacagttagacgtaggcgtagaatcattctgtttccagtaccttttcaagggcacatcaatccaatactacaactagccaacgttttgtactctaaaggtttttctattacaatctttcacaccaatttcaacaaaccaaaaacatccaattacccacatttcacattcagattcatacttgataatgatccacaagatgaacgtatttcaaacttacctacccacggtcctttagctggaatgagaattccaatcatcaatgaacatggtgccgatgagcttagaagagaattagagttacttatgttggcatccgaagaggacgaggaagtctcttgtctgattactgacgctctatggtactttgcccaatctgtggctgatagtttgaatttgaggagattggtactaatgacatccagtctgtttaactttcacgctcatgttagtttaccacaatttgacgaattgggatacttggaccctgatgacaagactaggttagaggaacaggcctctggttttcctatgttgaaagtcaaagatatcaagtctgcctattctaattggcaaatcttgaaagagatcttaggaaagatgatcaaacagacaaaggcttcatctggagtgatttggaacagtttcaaagagttagaagagtctgaattggagactgtaatcagagaaattccagcaccttcattcctgataccattaccaaaacatttgactgcttcctcttcctctttgttggatcatgacagaacagtttttcaatggttggaccaacaaccacctagttctgttttgtacgtgtcatttggtagtacttctgaagtcgatgaaaaggacttccttgaaatcgcaagaggcttagtcgatagtaagcagtcattcctttgggtcgtgcgtccaggtttcgtgaaaggctcaacatgggtcgaaccacttccagatggttttctaggcgaaagaggtagaatagtcaaatgggttcctcaacaggaagttttagctcatggcgctattggggcattctggactcattccggatggaattcaactttagaatcagtatgcgaaggggtacctatgatcttttcagattttggtcttgatcaaccactgaacgcaagatacatgtctgatgttttgaaagtgggtgtatatctagaaaatggctgggaaaggggtgaaatagctaatgcaataagacgtgttatggttgatgaagagggggagtatatcagacaaaacgcaagagtgctgaagcaaaaggccgacgtttctctaatgaagggaggctcttcatacgaatccttagaatctcttgtttcctacatttcatcactgtaagtcgac

SEQ ID NO: 86 - protein, 12 aa, Artificial Sequence
  Description of Artificial Sequence: Synthetic peptide
TSFAEYWNLLSP

SEQ ID NO: 87 - DNA, 1602 bp, Artificial Sequence
  Description of Artificial Sequence: Synthetic polynucleotide
atgaccagctttgccgagtattggaatctgttaagtcccacttcttttgcagaatattggaaccttctatcaccgacgagtttcgcggagtactggaatttgttttctccaacatcgttcgctgaatactggaacttactcagccctgctagtaaaatggatgcaatggcaactactgagaaaaagcctcatgtgatcttcattccatttcctgcacaatctcacataaaggcaatgctaaagttagcacaactattacaccataagggattacagataactttcgtgaataccgacttcatccataatcaatttctggaatctagtggccctcattgtttggacggagccccagggtttagattcgaaacaattcctgacggtgtttcacattccccagaggcctccatcccaataagagagagtttactgaggtcaatagaaaccaactttttggatcgtttcattgacttggtcacaaaacttccagacccaccaacttgcataatctctgatggctttctgtcagtgtttactatcgacgctgccaaaaagttgggtatcccagttatgatgtactggactcttgctgcatgcggtttcatgggtttctatcacatccattctcttatcgaaaagggttttgctccactgaaagatgcatcatacttaaccaacggctacctggatactgttattgactgggtaccaggtatggaaggtataagacttaaagattttcctttggattggtctacagaccttaatgataaagtattgatgtttactacagaagctccacaaagatctcataaggtttcacatcatatctttcacacctttgatgaattggaaccatcaatcatcaaaaccttgtctctaagatacaatcatatctacactattggtccattacaattacttctagatcaaattcctgaagagaaaaagcaaactggtattacatccttacacggctactctttagtgaaagaggaaccagaatgttttcaatggctacaaagtaaagagcctaattctgtggtctacgtcaacttcggaagtacaacagtcatgtccttggaagatatgactgaatttggttggggccttgctaattcaaatcattactttctatggattatcaggtccaatttggtaataggggaaaacgccgtattacctccagaattggaggaacacatcaaaaagagaggtttcattgcttcctggtgttctcaggaaaaggtattgaaacatccttctgttggtggtttccttactcattgcggttggggctctacaatcgaatcactaagtgcaggagttccaatgatttgttggccatattcatgggaccaacttacaaattgtaggtatatctgtaaagagtgggaagttggattagaaatgggaacaaaggttaaacgtgatgaagtgaaaagattggttcaggagttgatgggggaaggtggccacaagatgagaaacaaggccaaagattggaaggaaaaagccagaattgctattgctcctaacgggtcatcctctctaaacattgataagatggtcaaagagattacagtcttagccagaaactaa

SEQ ID NO: 88 - protein, 533 aa, Artificial Sequence
  Description of Artificial Sequence: Synthetic polypeptide
MTSFAEYWNLLSPTSFAEYWNLLSPTSFAEYWNLFSPTSFAEYWNLLSPASKMDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 89 - DNA, 1893 bp, Artificial Sequence
  Description of Artificial Sequence: Synthetic polynucleotide
atgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctaccggtggtagcggatcctctggaggcagtgctagtaaaatggcagagcaacaaaagatcaaaaagtcacctcacgtcttacttattccatttcctctgcaaggacatatcaacccattcatacaatttgggaaaagattgattagtaagggtgtaaagacaacactggtaaccactatccacactttgaattctactctgaaccactcaaatactactactacaagtatagaaattcaagctatatcagacggatgcgatgagggtggctttatgtctgccggtgaatcttacttggaaacattcaagcaagtgggatccaagtctctggccgatctaatcaaaaagttacagagtgaaggcaccacaattgacgccataatctacgattctatgacagagtgggttttagacgttgctatcgaatttggtattgatggaggttcctttttcacacaagcatgtgttgtgaattctctatactaccatgtgcataaagggttaatctctttaccattgggtgaaactgtttcagttccaggttttccagtgttacaacgttgggaaaccccattgatcttacaaaatcatgaacaaatacaatcaccttggtcccagatgttgtttggtcaattcgctaacatcgatcaagcaagatgggtctttactaattcattctataagttagaggaagaggtaattgaatggactaggaagatctggaatttgaaagtcattggtccaacattgccatcaatgtatttggacaaaagacttgatgatgataaagataatggtttcaatttgtacaaggctaatcatcacgaatgtatgaattggctggatgacaaaccaaaggaatcagttgtatatgttgctttcggctctcttgttaaacatggtccagaacaagttgaggagattacaagagcacttatagactctgacgtaaactttttgtgggtcattaagcacaaagaggaggggaaactgccagaaaacctttctgaagtgataaagaccggaaaaggtctaatcgttgcttggtgtaaacaattggatgttttagctcatgaatctgtaggctgttttgtaacacattgcggattcaactctacactagaagccatttccttaggcgtacctgtcgttgcaatgcctcagttctccgatcagacaaccaacgctaaacttttggacgaaatactaggggtgggtgtcagagttaaagcagacgagaatggtatcgtcagaagagggaacctagcttcatgtatcaaaatgatcatggaagaggaaagaggagttatcataaggaaaaacgcagttaagtggaaggatcttgcaaaggttgccgtccatgaaggcggctcttcagataatgatattgttgaatttgtgtccgaactaatcaaagcctaa

SEQ ID NO: 90 - protein, 630 aa, Artificial Sequence [sequence omitted]

SEQ ID NO: 91 - DNA, 1932 bp, Artificial Sequence
  Description of Artificial Sequence: Synthetic polynucleotide
atgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctaccggtggtagcggatcctctggaggcagtgctagtaaaatggctacatctgattctattgttgatgacaggaagcagttgcatgtggctactttcccttggcttgctttcggtcatatactgccttacctacaactatcaaaactgatagctgaaaaaggacataaagtgtcattcctttcaacaactagaaacattcaaagattatcttcccacatatcaccattgattaacgtcgttcaattgacacttccaagagtacaggaattaccagaagatgctgaagctacaacagatgtgcatcctgaagatatcccttacttgaaaaaggcatccgatggattacagcctgaggtcactagattccttgagcaacacagtccagattggatcatatacgactacactcactattggttgccttcaattgcagcatcactaggcatttctagggcacatttcagtgtaaccacaccttgggccattgcttacatgggtccatccgctgatgctatgattaacggcagtgatggtagaactaccgttgaagatttgacaaccccaccaaagtggtttccatttccaactaaagtctgttggagaaaacacgacttagcaagactggttccatacaaggcaccaggaatctcagacggctatagaatgggtttagtccttaaagggtctgactgcctattgtctaagtgttaccatgagtttgggacacaatggctaccacttttggaaacattacaccaagttcctgtcgtaccagttggtctattacctccagaaatccctggtgatgagaaggacgagacttgggtttcaatcaaaaagtggttagacgggaagcaaaaaggctcagtggtatatgtggcactgggttccgaagttttagtatctcaaacagaagttgtggaacttgccttaggtttggaactatctggattgccatttgtctgggcctacagaaaaccaaaaggccctgcaaagtccgattcagttgaattgccagacggctttgtcgagagaactagagatagagggttggtatggacttcatgggctccacaattgagaatcctgagtcacgaatctgtgtgcggtttcctaacacattgtggttctggttctatagttgaaggactgatgtttggtcatccacttatcatgttgccaatctttggtgaccagcctttgaatgcacgtctgttagaagataaacaagttggaattgaaatcccacgtaatgaggaagatggatgtttaaccaaggagtctgtggccagatcattacgttccgttgtcgttgaaaaggaaggcgaaatctacaaggccaatgcccgtgaactttcaaagatctacaatgacacaaaagtagagaaggaatatgtttctcaatttgtagattacctagagaaaaacgctagagccgtagctattgatcatgaatcctaa

SEQ ID NO: 92 - protein, 643 aa, Artificial Sequence
  Description of Artificial Sequence: Synthetic polypeptide
MCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTGGSGSSGGSASKMATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 93 - DNA, 1887 bp, Artificial Sequence
  Description of Artificial Sequence: Synthetic polynucleotide
atgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctaccggtggtagcggatcctctggaggcagtgctagtaaaatggaaaacaagaccgaaacaacagttagacgtaggcgtagaatcattctgtttccagtaccttttcaagggcacatcaatccaatactacaactagccaacgttttgtactctaaaggtttttctattacaatctttcacaccaatttcaacaaaccaaaaacatccaattacccacatttcacattcagattcatacttgataatgatccacaagatgaacgtatttcaaacttacctacccacggtcctttagctggaatgagaattccaatcatcaatgaacatggtgccgatgagcttagaagagaattagagttacttatgttggcatccgaagaggacgaggaagtctcttgtctgattactgacgctctatggtactttgcccaatctgtggctgatagtttgaatttgaggagattggtactaatgacatccagtctgtttaactttcacgctcatgttagtttaccacaatttgacgaattgggatacttggaccctgatgacaagactaggttagaggaacaggcctctggttttcctatgttgaaagtcaaagatatcaagtctgcctattctaattggcaaatcttgaaagagatcttaggaaagatgatcaaacagacaaaggcttcatctggagtgatttggaacagtttcaaagagttagaagagtctgaattggagactgtaatcagagaaattccagcaccttcattcctgataccattaccaaaacatttgactgcttcctcttcctctttgttggatcatgacagaacagtttttcaatggttggaccaacaaccacctagttctgttttgtacgtgtcatttggtagtacttctgaagtcgatgaaaaggacttccttgaaatcgcaagaggcttagtcgatagtaagcagtcattcctttgggtcgtgcgtccaggtttcgtgaaaggctcaacatgggtcgaaccacttccagatggttttctaggcgaaagaggtagaatagtcaaatgggttcctcaacaggaagttttagctcatggcgctattggggcattctggactcattccggatggaattcaactttagaatcagtatgcgaaggggtacctatgatcttttcagattttggtcttgatcaaccactgaacgcaagatacatgtctgatgttttgaaagtgggtgtatatctagaaaatggctgggaaaggggtgaaatagctaatgcaataagacgtgttatggttgatgaagagggggagtatatcagacaaaacgcaagagtgctgaagcaaaaggccgacgtttctctaatgaagggaggctcttcatacgaatccttagaatctcttgtttcctacatttcatcactgtaa

SEQ ID NO: 94 - protein, 628 aa, Artificial Sequence
  Description of Artificial Sequence: Synthetic polypeptide
MCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTGGSGSSGGSASKMENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 95 - protein, 473 aa, Stevia rebaudiana
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDRCRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSRAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 96 - DNA, 1422 bp, Stevia rebaudiana
atggctaccagtgactccatagttgacgaccgtaagcagcttcatgttgcgacgttcccatggcttgctttcggtcacatcctcccttaccttcagctttcgaaattgatagctgaaaagggtcacaaagtctcgtttctttctaccaccagaaacattcaacgtctctcttctcatatctcgccactcataaatgttgttcaactcacacttccacgtgtccaagagctgccggaggatgcagaggcgaccactgacgtccaccctgaagatattccatatctcaagaaggcttctgatggtcttcaaccggaggtcacccggtttctagaacaacactctccggactggattatttatgattatactcactactggttgccatccatcgcggctagcctcggtatctcacgagcccacttctccgtcaccactccatgggccattgcttatatgggaccctcagctgacgccatgataaatggttcagatggtcgaaccacggttgaggatctcacgacaccgcccaagtggtttccctttccgaccaaagtatgctggcggaagcatgatcttgcccgactggtgccttacaaagctccggggatatctgatcgatgccgtatggggctggttcttaagggatctgattgtttgctctccaaatgttaccatgagtttggaactcaatggctacctcttttggagacactacaccaagtaccggtggttccggtgggattactgccaccggaaatacccggagacgagaaagatgaaacatgggtgtcaatcaagaaatggctcgatggtaaacaaaaaggcagtgtggtgtacgttgcattaggaagcgaggttttggtgagccaaaccgaggttgttgagttagcattgggtctcgagctttctgggttgccatttgtttgggcttatagaaaaccaaaaggtcccgcgaagtcagactcggtggagttgccagacgggttcgtggaacgaactcgtgaccgtgggttggtctggacgagtcgggcacctcagttacgaatactgagccatgagtcggtttgtgggttcttgacgcattgtggttctggatcaattgtggaagggctaatgtttggtcaccctctaatcatgctaccgatttttggggaccaacctctgaatgctcgattactggaggacaaacaggtgggaatcgagataccaagaaatgaggaagatggttgcttgaccaaggagtcggttgctagatcactgaggtccgttgttgtggaaaaagaaggggagatctacaaggcgaacgcgagggagctgagtaaaatctataacgacactaaggttgaaaaagaatatgtaagccaattcgtagactatttggaaaagaatgcgcgtgcggttgccatcgatcatgagagttaa

SEQ ID NO: 97 - DNA, 1380 bp, Stevia rebaudiana
atggaaaataaaacggagaccaccgttcgccggcgccggagaataatattattcccggtaccatttcaaggccacattaacccaattcttcagctagccaatgtgttgtactctaaaggattcagtatcaccatctttcacaccaacttcaacaaacccaaaacatctaattaccctcacttcactttcagattcatcctcgacaacgacccacaagacgaacgcatttccaatctaccgactcatggtccgctcgctggtatgcggattccgattatcaacgaacacggagctgacgaattacgacgcgaactggaactgttgatgttagcttctgaagaagatgaagaggtatcgtgtttaatcacggatgctctttggtacttcgcgcaatctgttgctgacagtcttaacctccgacggcttgttttgatgacaagcagcttgtttaattttcatgcacatgtttcacttcctcagtttgatgagcttggttacctcgatcctgatgacaaaacccgtttggaagaacaagcgagtgggtttcctatgctaaaagtgaaagacatcaagtctgcgtattcgaactggcaaatactcaaagagatattagggaagatgataaaacaaacaaaagcatcttcaggagtcatctggaactcatttaaggaactcgaagagtctgagctcgaaactgttatccgtgagatcccggctccaagtttcttgataccactccccaagcatttgacagcctcttccagcagcttactagaccacgatcgaaccgtttttccatggttagaccaacaaccgtcacgttcggtactgtatgttagttttggtagtggtactgaagtactggatgagaaagatttcttggaaatagctcgtgggttggttgatagcaagcagtcgtttttatgggtggttcgacctgggtttgtcaagggttcgacgtgggtcgaaccgttgccagatgggttcttgggtgaaagaggacgtattgtgaaatgggttccacagcaagaagtgctagctcatggagcaataggcgcattctggactcatagcggatggaactctacgttggaaagcgtttgtgaaggtgttcctatgattttctcggattttgggctcgatcaaccgttgaatgctagatacatgagtgatgttttgaaggtaggggtgtatttggaaaatgggtgggaaagaggagagatagcaaatgcaataagaagagttatggtggatgaagaaggagaatacattagacagaatgcaagagttttgaaacaaaaggcagatgtttctttgatgaagggtggttcgtcttacgaatcattagagtctctagtttcttacatttcatcgttgtaa

SEQ ID NO: 98 - protein, 459 aa, Stevia rebaudiana
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFPWLDQQPSRSVLYVSFGSGTEVLDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 99 - DNA, 1380 bp, Stevia rebaudiana
  modified_base (861)..(863): a, c, t, g, unknown or other
  misc_feature (861)..(863): n is a, c, g, or t
atggaaaataaaacggagaccaccgttcgccggcgccggagaataatattattcccggtaccatttcaaggccacattaacccaattcttcagctagccaatgtgttgtactctaaaggattcagtatcaccatctttcacaccaacttcaacaaacccaaaacatctaattaccctcacttcactttcagattcatcctcgacaacgacccacaagacgaacgcatttccaatctaccgactcatggtccgctcgctggtatgcggattccgattatcaacgaacacggagctgacgaattacgacgcgaactggaactgttgatgttagcttctgaagaagatgaagaggtatcgtgtttaatcacggatgctctttggtacttcgcgcaatctgttgctgacagtcttaacctccgacggcttgttttgatgacaagcagcttgtttaattttcatgcacatgtttcacttcctcagtttgatgagcttggttacctcgatcctgatgacaaaacccgtttggaagaacaagcgagtgggtttcctatgctaaaagtgaaagacatcaagtctgcgtattcgaactggcaaatactcaaagagatattagggaagatgataaaacaaacaaaagcatcttcaggagtcatctggaactcatttaaggaactcgaagagtctgagctcgaaactgttatccgtgagatcccggctccaagtttcttgataccactccccaagcatttgacagcctcttccagcagcttactagaccacgatcgaaccgtttttcaatggttagaccaacaaccgccaagttcggtactgtatgttagttttggtagtactagtgaagtnnnggatgagaaagatttcttggaaatagctcgtgggttggttgatagcaagcagtcgtttttatgggtggttcgacctgggtttgtcaagggttcgacgtgggtcgaaccgttgccagatgggttcgtggccgaaagagggcgtattgtgaaatgggttccgcaacaggaagtgatagctcatggagcaatcggtgcattctggactcatagcggatggaactctacattggaaagcgtttgtgaaggtgttcctatgattttctcggattttgggctcgatcaaccgttgaatgctagatacatgagtgatgttttgaaggtaggggtgtatttggaaaatgggtgggaaagaggagagatagcaaatgcaatacgaagagttatggtggatgaagaaggagaatacattagacagaatgcaagagttttgaaacaaaaggcagatgtttctttgatgaagggtggttcatcttacgaatcattagagtctctagtttcttacatttcatcgttgtaa

SEQ ID NO: 100 - protein, 459 aa, Stevia rebaudiana
  MOD_RES (288)..(288): Any amino acid
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVXDEKDFLEIARGLVDSKQSFLWVVRPGFVKGSTWVEPLPDGFVAERGRIVKWVPQQEVIAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 101 - DNA, 1380 bp, Stevia rebaudiana
  modified_base (861)..(863): a, c, t, g, unknown or other
  misc_feature (861)..(863): n is a, c, g, or t
atggaaaataaaacggagaccaccgttcgccggcgccggagaataatattattcccggtaccatttcaaggccacattaacccaattcttcagctagccaatgtgttgtactctaaaggattcagtatcaccatctttcacaccaacttcaacaaacccaaaacatctaattaccctcacttcactttcagattcatcctcgacaacgacccacaagacgaacgcatttccaatctaccgactcatggtccgctcgctggtatgcggattccgattatcaacgaacacggagctgacgaattacgacgcgaactggaactgttgatgttagcttctgaagaagatgaagaggtatcgtgtttaatcacggatgctctttggtacttcgcgcaatctgttgctgacagtcttaacctccgacggcttgttttgatgacaagcagcttgtttaattttcatgcacatgtttcacttcctcagtttgatgagcttggttacctcgatcctgatgacaaaacccgtttggaagaacaagcgagtgggtttcctatgctaaaagtgaaagacatcaagtctgcgtattcgaactggcaaatactcaaagagatattagggaagatgataaaacaaacaaaagcatcttcaggagtcatctggaactcatttaaggaactcgaagagtctgagctcgaaactgttatccgtgagatcccggctccaagtttcttgataccactccccaagcatttgacagcctcttccagcagcttactagaccacgatcgaaccgtttttcaatggttagaccaacaaccgccaagttcggtactgtatgttagttttggtagtactagtgaagtnnnggatgagaaagatttcttggaaatagctcgtgggttggttgatagcaagcagtcgtttttatgggtggttcgacctgggtttgtcaagggttcgacgtgggtcgaaccgttgccagatgggttcttgggtgaaagaggacgtattgtgaaatgggttccacagcaagaagtgctagctcatggagcaataggcgcattctggactcatagcggatggaactctacgttggaaagcgtttgtgaaggtgttcctatgattttctcggattttgggctcgatcaaccgttgaatgctagatacatgagtgatgttttgaaggtaggggtgtatttggaaaatgggtgggaaagaggagagatagcaaatgcaataagaagagttatggtggatgaagaaggagaatacattagacagaatgcaagagttttgaaacaaaaggcagatgtttctttgatgaagggtggttcgtcttacgaatcattagagtctctagtttcttacatttcatcgttgtaa

SEQ ID NO: 102 - protein, 459 aa, Stevia rebaudiana
  MOD_RES (288)..(288): Any amino acid
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVXDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 103 - DNA, 1323 bp, Artificial Sequence
  Description of Artificial Sequence: Synthetic polynucleotide
atgcattctaccagacatatcttaagacaaagggccgtcctagttacaggcgctagaacaccattcgtgaaatcatttggggctcttatgaaagcagataccttggaattggcatcagcatcagtcgctgggttgctgaacaagacctcactggaccctagagatatcgatcatatcgtttggggtaatgttgtacttcaaggatcagctcataactgcgccagagaaatagttatcgaccttaacatgcctaaaaagatcatcggtaatttgacatctatggcctgtgcttcaggcttatcttctttgtcacaagcctgtatgctaatagagggtggtcatgccgatgtcgtcattgctggcggttctgattcagtctccaacactgaagtgcctttgccaagatccgtcacttacggtctaatgatggcccaaaggaagggtgttatgggcttctttaaggaagcaggatacaacccattcaaatggtttccaggcggtattgctttaaccgaacgtagtacaggaaaaactatgggttggcatggagacttaattgctgagttaaactctatatctagagatgaccaggaagccctggctgtggcttctcatgcaaatgctgctagagcagaaaaagctgggtactttaaggaggaaattgtacctgtgacaatcgacaaaaagggcaaaaagactgaagtaacatgtgatgatgttatgcaaagagatacagaaaagatgaaggccaagatgccatcattgaagcctgttttcagaaaagagggaggtacaataacagcagccacttccagtactctgactgatggtggctctgcaatgttggttatgtcagaggaaaaggccaaaaagttgggttatccaactgatgtctgcgtgaagtcttggtatttcagtggtatcgatccttacccacaacttttgttagcaccagttctaggttggggtccagctttgaaaaaggccggattaacccctaaagatatcgatttgtacgaaattcacgaagcatttgctgcacaagttctagccacaattaagtgtttgaagtctcaggaattcttcgataggtacgctaacggtgcaaagccagtattaactgaggatattgatctttctaaactaaatgttaatggcggttccttagcacttggccacccattcgccgctacaggaggtagaatcgtaatctctctagcaaatgagttgagaagatccggaaagagacacgggctggtcagtatttgtgcagctggagggttaggcggagtagctatacttgagcatacagcaagtaagtaa

SEQ ID NO: 104 - protein, 440 aa, Leishmania infantum
MHSTRHILRQRAVLVTGARTPFVKSFGALMKADTLELASASVAGLLNKTSLDPRDIDHIVWGNVVLQGSAHNCAREIVIDLNMPKKIIGNLTSMACASGLSSLSQACMLIEGGHADVVIAGGSDSVSNTEVPLPRSVTYGLMMAQRKGVMGFFKEAGYNPFKWFPGGIALTERSTGKTMGWHGDLIAELNSISRDDQEALAVASHANAARAEKAGYFKEEIVPVTIDKKGKKTEVTCDDVMQRDTEKMKAKMPSLKPVFRKEGGTITAATSSTLTDGGSAMLVMSEEKAKKLGYPTDVCVKSWYFSGIDPYPQLLLAPVLGWGPALKKAGLTPKDIDLYEIHEAFAAQVLATIKCLKSQEFFDRYANGAKPVLTEDIDLSKLNVNGGSLALGHPFAATGGRIVISLANELRRSGKRHGLVSICAAGGLGGVAILEHTASK

SEQ ID NO: 105 - DNA, 1584 bp, Artificial Sequence
  Description of Artificial Sequence: Synthetic polynucleotide
atggcagctgaccaattggtgaaaactgaagtcaccaagaagtcttttactgctcctgtacaaaaggcttctacaccagttttaaccaataaaacagtcatttctggatcgaaagtcaaaagtttatcatctgcgcaatcgagctcatcaggaccttcatcatctagtgaggaagatgattcccgcgatattgaaagcttggataagaaaatacgtcctttagaagaattagaagcattattaagtagtggaaatacaaaacaattgaagaacaaagaggtcgctgccttggttattcacggtaagttacctttgtacgctttggagaaaaaattaggtgatactacgagagcggttgcggtacgtaggaaggctctttcaattttggcagaagctcctgtattagcatctgatcgtttaccatataaaaattatgactacgaccgcgtatttggcgcttgttgtgaaaatgttataggttacatgcctttgcccgttggtgttataggccccttggttatcgatggtacatcttatcatataccaatggcaactacagagggttgtttggtagcttctgccatgcgtggctgtaaggcaatcaatgctggcggtggtgcaacaactgttttaactaaggatggtatgacaagaggcccagtagtccgtttcccaactttgaaaagatctggtgcctgtaagatatggttagactcagaagagggacaaaacgcaattaaaaaagcttttaactctacatcaagatttgcacgtctgcaacatattcaaacttgtctagcaggagatttactcttcatgagatttagaacaactactggtgacgcaatgggtatgaatatgatttctaaaggtgtcgaatactcattaaagcaaatggtagaagagtatggctgggaagatatggaggttgtctccgtttctggtaactactgtaccgacaaaaaaccagctgccatcaactggatcgaaggtcgtggtaagagtgtcgtcgcagaagctactattcctggtgatgttgtcagaaaagtgttaaaaagtgatgtttccgcattggttgagttgaacattgctaagaatttggttggatctgcaatggctgggtctgttggtggatttaacgcacatgcagctaatttagtgacagctgttttcttggcattaggacaagatcctgcacaaaatgttgaaagttccaactgtataacattgatgaaagaagtggacggtgatttgagaatttccgtatccatgccatccatcgaagtaggtaccatcggtggtggtactgttctagaaccacaaggtgccatgttggacttattaggtgtaagaggcccgcatgctaccgctcctggtaccaacgcacgtcaattagcaagaatagttgcctgtgccgtcttggcaggtgaattatccttatgtgctgccctagcagccggccatttggttcaaagtcatatgacccacaacaggaaacctgctgaaccaacaaaacctaacaatttggacgccactgatataaatcgtttgaaagatgggtccgtcacctgcattaaatcctaa

SEQ ID NO: 106 - protein, 527 aa, Saccharomyces cerevisiae
MAADQLVKTEVTKKSFTAPVQKASTPVLTNKTVISGSKVKSLSSAQSSSSGPSSSSEEDDSRDIESLDKKIRPLEELEALLSSGNTKQLKNKEVAALVIHGKLPLYALEKKLGDTTRAVAVRRKALSILAEAPVLASDRLPYKNYDYDRVFGACCENVIGYMPLPVGVIGPLVIDGTSYHIPMATTEGCLVASAMRGCKAINAGGGATTVLTKDGMTRGPVVRFPTLKRSGACKIWLDSEEGQNAIKKAFNSTSRFARLQHIQTCLAGDLLFMRFRTTTGDAMGMNMISKGVEYSLKQMVEEYGWEDMEVVSVSGNYCTDKKPAAINWIEGRGKSVVAEATIPGDVVRKVLKSDVSALVELNIAKNLVGSAMAGSVGGFNAHAANLVTAVFLALGQDPAQNVESSNCITLMKEVDGDLRISVSMPSIEVGTIGGGTVLEPQGAMLDLLGVRGPHATAPGTNARQLARIVACAVLAGELSLCAALAAGHLVQSHMTHNRKPAEPTKPNNLDATDINRLKDGSVTCIKS

SEQ ID NO: 107 - DNA, 3681 bp, Artificial Sequence
  Description of Artificial Sequence: Synthetic polynucleotide
atgagagctgtccttagattgttatcaacacatactgttttctctcctattgaaacaattgtatctgttttcgtgttagctacattagcttacttccacatcttgtccggaatcaagcactcaagtttctttgcatcttctcatcctcctgctatcagacctgcttttgcacatctgaccaacggggaatgggttgccgtctcccaacatgattggactgaagcatggaagcatcctggcggttcacttgatgcattagaacttcaacaagtagttttcactttagatgacaagactcaaccatctgctgtgctagatgcatccgcaattagtcagcacttagtttccaatgttcctgcattatctggaaaagcctactcttcattgtgccaccatccaaatgtatcaggcacctcctgttttacatcagtttctggtccaggagcttcaccaatcttgacactgagttttaagcctggaactagagacgattggttaggatcattaaggaaggagaaaactatcacactagatggggttaagtacgacgttggagccggaaaaagacaagagtcaatcggcgatatggaatcatctaagtgggttgcttatgcattatcagctttggtacttagattttgggaattaacaaaggcagattccttagatatactagtggttctaactgggtacatcctaatgcacgtaacattcatgagattgttcttggcatccagagcacttggcagtaacttttggttatcagctggcatattctcctccgcaacaatttctttcctattcactttaccaatgtgtagatctatggatattccacttgatccaattgccttgacagaagccctgccattcttggtgtgtaccgtaggttttgacaaaccacttagattggcaagagctgtgatggctcatcctaatatccttaaacctcaagatgatggtaggatgaaagctgccggagatgtcattcttgaggcactggacagagttggtaacatgatattgagagattacgctttagagatcgcagttctattcgttggcgttaactccagagttggcggtcttaaggaattttgtgctgtagctgcagcattacttgctatggacagattaatgacattcacactttatacagcagtgttaaccatcatggttgaggtaaggcgtatcaaaaaggtcagagatatgactaaggctagatctagaagttcttctattaccgccgttacagccaacggcaccgccataagaggcgttttgagtagaaaatcttcaaaacaatctgtgacagaaccagagacaactaaaaacctaagacaaagagccactgattcagccatcggtgttaagggttcattgctgaaagatggaggcagattgcaggaagccgaggagaatccaatggcaagattaaagctattgttaatcgcttccttcttaacactacacatcttgaacttttgtactactttgacttcagccacagctaacgcaagacatcaaagacatccttttagaaccgttcaagaggtagtaccaattcctagagttgacattactaccccagccatagccaatatcttgtctcatctagctgtggctcaggaacctatgttcactgttgttggcagtgaacctatcgaacttcttgttaaagtcgctgctccagtctacgtccatgctctaccattggcccctgctttaagagcttcaaacactaatactggagaagctattgaaaactttatgagttcatggtctagtctggtaggtgacccagttgttagtaagtggatcgtagcattgctagctgtctctgttgcattgaatggatacttgttaaagggtatagccgcaggttccgggttggctgccatgagagctgttagatctcaaggtgttcgtttcagatctagagctagaagtatcgtaaagatatctgatgaacctgagccagagccagaacactctatcgacccagcaccagtagtgttcttcgcttccgcagcaccagctgtagaggcccctgctccagctcctgcacctgaaccagaaccaccagtcaacagaccaccaccattgactattttctcaagaccactgaacttagaaacagtggacaaaaagttacaagatgctctgccaataagatccccaccacctgttgaaccaatcactccagaatctagagaagtggaaccaacccaagtagaagtaagatctctagctgaatgtgtggatgtgttcgagaatgggccaagaccagtctcagtggctttaaagactctgaatgatgaggaagttatcctgctttgccaaacaggtaagatagctccatatgcattggttaagatgttggctgatttcgatagggccgtacgtgtcagaagagcacttattagtagagcttcacgtacaaaaactttagaaaactcactggttcctatgaaagattatgattacgccagagtcatgggtgcctgttgtgaaaacgttatcggatacatgccattaccactagggattgcaggtccattgaagattgatggcttgatgtatcctataccaatggcaaccgcagaaggtaccttggttgcatctacttctaggggctgtaaggccttaaatgctggtggaggggtcacaactgtcttgacagcagatggcatgacaagagggccagctatagactttccttccatcgtcagagctgcagaggctaaggccttcattgaatcagaagatggatacgctacaatcagggaggctttcgagtctacttctagatttgccaagttgcaaaagatcaagtgtgcactagctggtcgtactctttttgtcagatttgctactagaacaggagatgccatgggtatgaacatgatttctaaggctaccgaaaaggcacttgatgtcctgagtcacgagttccctgaaatggtcgtccttgctttgtctggtaactactgcacagacaaaaagcctgcagctatttcatggatcgaaggtaggggaaaatctattgtagcagaagcagttattcctggtaaggtcgttaagtcagtcctgaaaacaacagtcgagtctctttgcaatgtcaacactaagaaaaacctgattggttcagccatggcaggttctgttggtggtttcaacgctcatgccgccaacatcctaacagctgtgttcctagccacaggtcaggatcctgctcaaaatgtcgaatcttctaattgcatgactttaatggaaccaacaaacggcggtgaggatttgctaatgacaatttcaatgccatgtatagaggtaggaaccgttggtggagggacaattctggaaccacaaggtgcagttttggatttgttgggcgttagaggggctcaccctactaatcctggtcaaaacgctcaacagttagccagaattatcgcatcagctgtaatggcaggcgaattgtctttgataagtgccttagccgcaggtcatttggttagagctcatcttgcccacaatcgttctcaattgaatacaccaatgccatccagaccacatactcctggccctgaggatgtctcacatgtgcagcagctacctacaccatctgcatctgatgataaaggtgttacagctcaaggttacgttgtcgaagcaaaataa

SEQ ID NO: 108 - protein, 1226 aa, Ganoderma lucidum
MRAVLRLLSTHTVFSPIETIVSVFVLATLAYFHILSGIKHSSFFASSHPPAIRPAFAHLTNGEWVAVSQHDWTEAWKHPGGSLDALELQQVVFTLDDKTQPSAVLDASAISQHLVSNVPALSGKAYSSLCHHPNVSGTSCFTSVSGPGASPILTLSFKPGTRDDWLGSLRKEKTITLDGVKYDVGAGKRQESIGDMESSKWVAYALSALVLRFWELTKADSLDILVVLTGYILMHVTFMRLFLASRALGSNFWLSAGIFSSATISFLFTLPMCRSMDIPLDPIALTEALPFLVCTVGFDKPLRLARAVMAHPNILKPQDDGRMKAAGDVILEALDRVGNMILRDYALEIAVLFVGVNSRVGGLKEFCAVAAALLAMDRLMTFTLYTAVLTIMVEVRRIKKVRDMTKARSRSSSITAVTANGTAIRGVLSRKSSKQSVTEPETTKNLRQRATDSAIGVKGSLLKDGGRLQEAEENPMARLKLLLIASFLTLHILNFCTTLTSATANARHQRHPFRTVQEVVPIPRVDITTPAIANILSHLAVAQEPMFTVVGSEPIELLVKVAAPVYVHALPLAPALRASNTNTGEAIENFMSSWSSLVGDPVVSKWIVALLAVSVALNGYLLKGIAAGSGLAAMRAVRSQGVRFRSRARSIVKISDEPEPEPEHSIDPAPVVFFASAAPAVEAPAPAPAPEPEPPVNRPPPLTIFSRPLNLETVDKKLQDALPIRSPPPVEPITPESREVEPTQVEVRSLAECVDVFENGPRPVSVALKTLNDEEVILLCQTGKIAPYALVKMLADFDRAVRVRRALISRASRTKTLENSLVPMKDYDYARVMGACCENVIGYMPLPLGIAGPLKIDGLMYPIPMATAEGTLVASTSRGCKALNAGGGVTTVLTADGMTRGPAIDFPSIVRAAEAKAFIESEDGYATIREAFESTSRFAKLQKIKCALAGRTLFVRFATRTGDAMGMNMISKATEKALDVLSHEFPEMVVLALSGNYCTDKKPAAISWIEGRGKSIVAEAVIPGKVVKSVLKTTVESLCNVNTKKNLIGSAMAGSVGGFNAHAANILTAVFLATGQDPAQNVESSNCMTLMEPTNGGEDLLMTISMPCIEVGTVGGGTILEPQGAVLDLLGVRGAHPTNPGQNAQQLARIIASAVMAGELSLISALAAGHLVRAHLAHNRSQLNTPMPSRPHTPGPEDVSHVQQLPTPSASDDKGVTAQGYVVEAK

SEQ ID NO: 109 - DNA, 2667 bp, Artificial Sequence
  Description of Artificial Sequence: Synthetic polynucleotide
atgttatcaagattgttcagaatgcatggtctatttgttgcttctcacccttgggaagtaatagttggtactgtaacattaacgatctgtatgatgtctatgaacatgtttaccggaaacaacaagatttgtggttggaattatgagtgtcctaagctggaagaggatgtgttgagttcagacatcatcatacttactataacaagatgcattgcaatattgtatatctacttccaatttcaaaaccttagacaattgggtagtaaatacatcctaggcatcgccggattgttcactattttctctagttttgttttctcaaccgtcgttattcactttttggacaaagagttaactggtttgaacgaagctctaccattcttcttgctgctggtagatttgtccagagcttccgctttagctaaattcgctctgtcctctaattctcaagatgaagttagagagaatatagcaaggggaatggccatacttggacctactttcacacttgatgcccttgtcgaatgtttggttattggggttggcacaatgtccggcgttagacagttagaaatcatgtgttgttttggctgtatgagtgtcttggctaactactttgtctttatgacattctttccagcttgcgtttctttggtattggagctgtcaagagaatcaagagaaggcagaccaatatggcaactatcacatttcgccagagtgttagaagaggaggaaaacaaacctaatcctgtcacacagagagtgaaaatgatcatgtctttgggtttagtcctagtgcatgctcattctagatggatcgcagatccatcccctcagaattctacagctgataactctaaagttagtttaggtttagatgaaaatgtaagtaagaggattgaaccttccgtgtctttgtggcaattctacttatcaaaaatgatttccatggatattgaacaagtgataacgttgtctttggctttattgttagccgttaagtacattttctttgagcaagccgaaacggaatctacattatcactgaaaaacccaattacatccccagtcgttacccagaaaaagataactgatgattgctgtagaagagatccagtgttggtcaggaatgatcaaaagttccacgccatggaggaggaaactaggaaaaacagagaaaggaaagttgaagttatcaagcctctattagcagaaaatgacacttcacatagggccactttcgttgtcggcaattcatctcttttaggtacgtcattggagctggaaacacaggaaccagaaatggaactaccagttgaaccaagaccaaatgaggaatgtttgcaaatactagagaacgctgaaaagggagccaagttcctatctgatgccgagattatccagctggtcaatgccaagcacattcctgcctacaagttggaaacccttatggagacacatgagagaggtgtgtctattaggagacaattactatctaaaaagttacctgaaccaagttccctacaatacctgccttatagagattacaattactccttggtaatgggagcttgttgtgaaaatgtcattgggtacatgccaattccagtgggtgtcgccggtccactatgtttggacggtaaggaatttcaagtacctatggcaacgactgaaggctgcttagttgcatctacaaacagaggttgtagagccattggattaggtggcggtgcttcttcaagagtcttggctgacggtatgactagaggtcctgttgtgagatttcctagggcctgtgactctgcagaagttaaggcttggttggaaactccagaaggtttcaccgtaatcaaagaggcctttgattccacatcaagggtggccagattacaaaaactacacatgtctgtcgctgggagaaatctgtatatcagatttcaatccagatccggcgacgcaatgggtatgaatatgatttcaaaagggacagaaaaggctttgtcaaagctgcaggagtatttcccagagatgcaaatcttggccgtatctggcaactattgcacagacaaaaagcctgccgccatcaactggattgaaggaagaggcaaatctgtggtttgtgaagctgtaattccagccaaagttgttagagaagtgttaaagaccacaacagaagctatgattgaagtaaacataaacaaaaacttagtagggtctgccatggctggttcaattggaggatacaacgctcatgctgccaatattgtaaccgctatctacatcgcatgtggacaagatgctgcccaaaatgtcggttcctcaaattgcatcacattgatggaagcatctggccctacaaacgaggatttgtatatcagttgcacaatgccatctatagaaatagggactgtgggaggaggaactaacttacttccacagcaagcctgcttacaaatgctgggtgtacaaggagcctgtagagataatccaggggagaacgctagacaacttgccagaattgtttgtgggacagttatggctggtgaacttagtctaatggcagctttggctgctgggcacctggtgagatctcatatgattcataatagaagtaagattaaccttcaagatttgcaaggtacgtgtacgaaaaaggctgcctaa

SEQ ID NO: 110 - protein, 888 aa, Bos taurus
MLSRLFRMHGLFVASHPWEVIVGTVTLTICMMSMNMFTGNNKICGWNYECPKLEEDVLSSDIIILTITRCIAILYIYFQFQNLRQLGSKYILGIAGLFTIFSSFVFSTVVIHFLDKELTGLNEALPFFLLLVDLSRASALAKFALSSNSQDEVRENIARGMAILGPTFTLDALVECLVIGVGTMSGVRQLEIMCCFGCMSVLANYFVFMTFFPACVSLVLELSRESREGRPIWQLSHFARVLEEEENKPNPVTQRVKMIMSLGLVLVHAHSRWIADPSPQNSTADNSKVSLGLDENVSKRIEPSVSLWQFYLSKMISMDIEQVITLSLALLLAVKYIFFEQAETESTLSLKNPITSPVVTQKKITDDCCRRDPVLVRNDQKFHAMEEETRKNRERKVEVIKPLLAENDTSHRATFVVGNSSLLGTSLELETQEPEMELPVEPRPNEECLQILENAEKGAKFLSDAEIIQLVNAKHIPAYKLETLMETHERGVSIRRQLLSKKLPEPSSLQYLPYRDYNYSLVMGACCENVIGYMPIPVGVAGPLCLDGKEFQVPMATTEGCLVASTNRGCRAIGLGGGASSRVLADGMTRGPVVRFPRACDSAEVKAWLETPEGFTVIKEAFDSTSRVARLQKLHMSVAGRNLYIRFQSRSGDAMGMNMISKGTEKALSKLQEYFPEMQILAVSGNYCTDKKPAAINWIEGRGKSVVCEAVIPAKVVREVLKTTTEAMIEVNINKNLVGSAMAGSIGGYNAHAANIVTAIYIACGQDAAQNVGSSNCITLMEASGPTNEDLYISCTMPSIEIGTVGGGTNLLPQQACLQMLGVQGACRDNPGENARQLARIVCGTVMAGELSLMAALAAGHLVRSHMIHNRSKINLQDLQGTCTKKAA

SEQ ID NO: 111 - DNA, 1704 bp, Artificial Sequence
  Description of Artificial Sequence: Synthetic polynucleotide
atggatttgagaaggaaattaccacctaagcctccatcttcaacaacaacaaaacagccaagtcataggtcccattctcctacgccaattccaaaggcttcagatgcattgcctcttccattgtacctgaccaatacgtttttcttcactcttttcttttccgtagcatattacctgttgcataggtggagagacaagattagatccggaacacctttacacgttgtgacactgactgaactatccgcaattgtactgctgattgcttccttcatctatcttttaggctttttcggtattgattttgtgcaatctttcacatcaagagaaaatgagcaactaaacaacgatgatcacaacgtcgtgtcaacaaacaatgttttatctgatagaaggttagtttacgactatggattcgatgtgacaggagacaacgataacgataatgatgacgatgttattgtgaaaagtgtcgtttctggggaagttaattcttatagtttggaggcttccctaggagattgttacagagccgcaaagattagaaagagagccgtcgagagaattgtcgggagagaagtattaggcttgggtttcgagggatttgattatgaatctatcctggggcaatgttgtgaaatgcctatcgggtacgtccaagtgccagtaggtgtcgctggacctttattgttaaatggtggggaattcatggttccaatggctacaactgaaggctgtcttgtagcttccactaatagaggttgtaaagccatatgcttatcaggtggtgccactgccatattgctaaaagatggtatgacaagagccccagtagtgagattcgccacagctgagagagcttcacaactaaagttttacttggaagatggtgtcaatttcgatacattgtctgttgtctttaacaaaagttcaagatttgccagattgcaaaacatccaatgctcaattgccggtaaaaacttgtacattaggtttacttgctccacaggcgacgccatgggtatgaacatggtttcaaaaggagtacaaaatgtattagactttttacaaaatgattttcctgatatggacgtaattgggatctcttggaagttctgctctgacaaaaagccaacagctgtcaactggattgagggcagaggaaagtctgtcgttttccaggccgtaattaccaaaaaggtggttagaaagtctgcactgaaccctcaaacttgcacatgtagaactttgacctgtttaagaccattattggttctgctacttctggttttgctagtggacttaatgcatatgcttcatatcgtgtctgccgtgttcatcgctaccggtcaagatccagctcagaatatcgaatctagtcactgtatcactatgatggaggctgtcaacaatggtaaggatttgcacgttaatgttacgatgccatctatagaagttggcacggtgggaggtggcactcagctagcctctcaatcagcctgtttgaacttgcttggtgtaaagggtgcctgtatagaatccccaggatcaaacgcccagttgttagctagaatcgttgctggttctgttctggcaggcgaattaagtttgatgtcagctataagtgctgggcaactagttaaatctcatatgaaatacaataggtctagtagagatatgtcagcaatagcttctaaggtctaa

SEQ ID NO: 112 - protein, 567 aa, Artemisia annua
MDLRRKLPPKPPSSTTTKQPSHRSHSPTPIPKASDALPLPLYLTNTFFFTLFFSVAYYLLHRWRDKIRSGTPLHVVTLTELSAIVLLIASFIYLLGFFGIDFVQSFTSRENEQLNNDDHNVVSTNNVLSDRRLVYDYGFDVTGDNDNDNDDDVIVKSVVSGEVNSYSLEASLGDCYRAAKIRKRAVERIVGREVLGLGFEGFDYESILGQCCEMPIGYVQVPVGVAGPLLLNGGEFMVPMATTEGCLVASTNRGCKAICLSGGATAILLKDGMTRAPVVRFATAERASQLKFYLEDGVNFDTLSVVFNKSSRFARLQNIQCSIAGKNLYIRFTCSTGDAMGMNMVSKGVQNVLDFLQNDFPDMDVIGISWKFCSDKKPTAVNWIEGRGKSVVFQAVITKKVVRKSALNPQTCTCRTLTCLRPLLVLLLLVLLVDLMHMLHIVSAVFIATGQDPAQNIESSHCITMMEAVNNGKDLHVNVTMPSIEVGTVGGGTQLASQSACLNLLGVKGACIESPGSNAQLLARIVAGSVLAGELSLMSAISAGQLVKSHMKYNRSSRDMSAIASKV

SEQ ID NO: 113 - DNA, 1308 bp, Artificial Sequence
  Description of Artificial Sequence: Synthetic polynucleotide
atgtttagaagagctatactgttaggatgctctgctgccaagacaccatggtctgagtgttctaacgctcaattagttgatgcagttaagtctagaaagatctcattctacggtcttgaacaagccttggaaccagattatagaagggctatcgaagtaaggagagaggttgtctctgaaatcgcctcacaacagccagaagcaaaaaagaagcaatccgcattgcacacaataccatttgagaattatgattggaataaggtcgttggccaaaactgtgaaaacattattggatacgtcccaataccactgggcgttgctggccctattttgattgatggtaaagagtacccaataccaatggctacaacagaaggcgctttggtcgctagtactcatagaggtgctagagctattacaagatccggaggttgtaagacattgttattaggtgaaggtatgacaagagcaccagtggttgaattgccttcattagaggaagctgggcgtttgcacaagtactgtaatgagaacttcttatctttaaaggaagcatttgaatcaactacccaatatggaaaacttaattctttaaagtgcgtactagctggtagaaaagcataccttagattcagagccactacaggcgatgctatgggcatgaacatgataacaaagggtgtagacaaagcactgtctgttctacagcaacatttcccttcaatggaaatcctagccctaagtggtaattactgtaccgacaaaaagccatctgctgtaaattggattgatggcagaggtaaatcagtggttgcagaagccactttattggctgatgttgtcgaagatactctgaaatgtacagtcgattctttggtatccttgaatatcgacaaaaaccttgttgggtcagctatggctggttctgttggaggttttaacgcccaggctgcaaacgctgtggcagccattttcattgcaaccggtcaagatcctgctcaagtggtagaaagttcaatgtgtatcactacaatgtccaaggtaggtaacgatctattgatctctgtgaccatgccttctatcgaggtcggggtcgtgggaggagggactggtcttgctgcccaaagaggatgcttagagttaatagggtgcggaggcccatctaaggagtctcctggtactaatgcccaacttctaagtagagttgttgcagctggcgttttatcagccgaactttccttgatgtccggactggcagcaggtcatctattgtcagcacatatgagattgaacagaaagaagaaataa

SEQ ID NO: 114 - protein, 435 aa, Trypanosoma cruzi
MFRRAILLGCSAAKTPWSECSNAQLVDAVKSRKISFYGLEQALEPDYRRAIEVRREVVSEIASQQPEAKKKQSALHTIPFENYDWNKVVGQNCENIIGYVPIPLGVAGPILIDGKEYPIPMATTEGALVASTHRGARAITRSGGCKTLLLGEGMTRAPVVELPSLEEAGRLHKYCNENFLSLKEAFESTTQYGKLNSLKCVLAGRKAYLRFRATTGDAMGMNMITKGVDKALSVLQQHFPSMEILALSGNYCTDKKPSAVNWIDGRGKSVVAEATLLADVVEDTLKCTVDSLVSLNIDKNLVGSAMAGSVGGFNAQAANAVAAIFIATGQDPAQVVESSMCITTMSKVGNDLLISVTMPSIEVGVVGGGTGLAAQRGCLELIGCGGPSKESPGTNAQLLSRVVAAGVLSAELSLMSGLAAGHLLSAHMRLNRKKK

SEQ ID NO: 115 - DNA, 1281 bp, Artificial Sequence
  Description of Artificial Sequence: Synthetic polynucleotide
atgcaatccctggacaaaaactttagacacttatcaagacaacagaagttacaacagctagttgataaacaatggctatcagaggaacaattcaatattctacttaaccacccacttattgatgaagaggtagcaaactcattgatagaaaatgtcatcgcacagggcgcactgcctgttggtttactaccaaatatcatcgttgatgacaaagcatacgtcgtgcctatgatggtggaagagccatctgttgttgccgctgcttcatacggcgctaaattggtgaaccaaacaggtggtttcaaaaccgtgtcctcagaacgtatcatgataggtcaaatagtatttgatggagtcgatgataccgagaaactgtctgcagatatcaaggctcttgaaaaacaaatccatcagattgcagatgaggcttacccttctattaaggccagaggtggaggctatcaaaggatcgccatcgatacattcccagaacaacagttgctttcattgaaggttttcgttgatactaaggatgctatgggcgctaatatgttaaacacaatcctagaagcaatcacagcctttttgaaaaacgaattcccacaatctgatatcttgatgtctatcctttccaaccacgcaacagccagtgttgtcaaggtccagggtgaaatagacgttaaggatttggcaagaggagaacgtactggagaagaggtcgctaagagaatggaaagagcatctgtgttagctcaagtggacattcatagagcagcaacacacaataagggtgttatgaatggcattcatgctgtagtcttggctacaggtaatgatactagaggtgcagaagcctctgctcacgcttacgcttccaaagacggtcaatatagagggatagctacatggagatacgatcaagagagacaaaggttaataggaactatagaagttccaatgactctggccattgttggtggcggtaccaaggtactgcctattgctaaggcctctttagaactgttaaacgtagaaagtgcccaagagttgggacatgttgtcgctgccgttggactagctcaaaacttcgctgcatgtagagctttggtttccgaaggtattcaacaagggcatatgtctttgcaatacaagtctttagccatcgtagtcggggctaagggcgatgaaattgctcaggtagccgaagcactaaagcaagagccaagagcaaacactcaagttgcagagagaattttgcaagatttgagaagtcaacaataa

SEQ ID NO: 116 - protein, 426 aa, Staphylococcus aureus
MQSLDKNFRHLSRQQKLQQLVDKQWLSEEQFNILLNHPLIDEEVANSLIENVIAQGALPVGLLPNIIVDDKAYVVPMMVEEPSVVAAASYGAKLVNQTGGFKTVSSERIMIGQIVFDGVDDTEKLSADIKALEKQIHQIADEAYPSIKARGGGYQRIAIDTFPEQQLLSLKVFVDTKDAMGANMLNTILEAITAFLKNEFPQSDILMSILSNHATASVVKVQGEIDVKDLARGERTGEEVAKRMERASVLAQVDIHRAATHNKGVMNGIHAVVLATGNDTRGAEASAHAYASKDGQYRGIATWRYDQERQRLIGTIEVPMTLAIVGGGTKVLPIAKASLELLNVESAQELGHVVAAVGLAQNFAACRALVSEGIQQGHMSLQYKSLAIVVGAKGDEIAQVAEALKQEPRANTQVAERILQDLRSQQ

SEQ ID NO: 117 - DNA, 1311 bp, Artificial Sequence
  Description of Artificial Sequence: Synthetic polynucleotide
atgcaggtcttaagattggataggagacattacaaaagtggcaagattagaagagcaatgagttctagaattcctggtttctacaaattgtcagtcgaggaaagactgaaaaaggttgctgaatttgcagggttatctgatgaggaagtgaaagctgttttgtcacaaggtttacctttggacgtagctgatagaatgatcgaaaatgtgatcggtacatttgaattaccacttggtatagcaaccaatttccttattgatggcaaggattatctaatccctatggctatagaggaaccatcagtagttgcagctgcttctaacgcagctagaatggccagagagtctggcgggtttacaactgattacacagggtccctgatgattggtcaaattcaagtcacaaaactgttgaatccaaatgcagctaagttcgaagttctacgtcaaaaagacgaaatcatagaaagagcaaatgagtgtgatccaatgttggtgaatttgggcggtggatgtaaagatatagaagcaagggtgatcgatacaatcatgggtaagatgctaattgttcatctgatcgttgatgttaaagacgctatgggtgcaaatgctgtcaacactatgtgtgaaaaagttgctcctttcatcgaacgtattactgggggaaaggtctatcttagaatcatttccaacttggctgcatatagacttgctagagcaaaggccgtttttgacaaagacgttattggcggagaggaggttgtagaagggatcatgcttgcatacgccttcgctgccgctgacccatttcgttgcgccacccacaataagggtatcatgaatggcatatcagccttaatgatcgctacaggaaacgactttagagccattgaagcaggagctcattcctatgctgcaataggtggatacaaaccactaactacctacgaagttgatagaaaaggtaatctagtaggcacaattgaaatacctatggcagtaggcgtgattggtggtgcaaccaaagtcaacccactagccaagatctctcttaagatactaggagtgaacactgctgaagagttagccagagtcgcagccgctctaggtttggctcaaaactttgctgccttaagagccttggccacagaaggtatccaaagaggtcacatggaattacatgccaggaacttagcaatcatggctggagctactggagatgaggttgacagagttgtagagattatggtgagagatggcaaaatcagattggactacgctaaggaagtattggagagactgcgttcctaa

SEQ ID NO: 118 - protein, 436 aa, Archaeoglobus fulgidus
MQVLRLDRRHYKSGKIRRAMSSRIPGFYKLSVEERLKKVAEFAGLSDEEVKAVLSQGLPLDVADRMIENVIGTFELPLGIATNFLIDGKDYLIPMAIEEPSVVAAASNAARMARESGGFTTDYTGSLMIGQIQVTKLLNPNAAKFEVLRQKDEIIERANECDPMLVNLGGGCKDIEARVIDTIMGKMLIVHLIVDVKDAMGANAVNTMCEKVAPFIERITGGKVYLRIISNLAAYRLARAKAVFDKDVIGGEEVVEGIMLAYAFAAADPFRCATHNKGIMNGISALMIATGNDFRAIEAGAHSYAAIGGYKPLTTYEVDRKGNLVGTIEIPMAVGVIGGATKVNPLAKISLKILGVNTAEELARVAAALGLAQNFAALRALATEGIQRGHMELHARNLAIMAGATGDEVDRVVEIMVRDGKIRLDYAKEVLERLRS

SEQ ID NO: 119 - DNA, 1287 bp, Artificial Sequence
  Description of Artificial Sequence: Synthetic polynucleotide
atgtccttagattcaagactgccagctttcagaaatctgtctccagctgcaagactagatcacattggccaacttttgggactaagtcatgacgacgtttcccttttagcaaacgccggtgctttaccaatggatatcgctaatggtatgattgaaaatgtaatcgggacctttgaactgccatatgcagtggccagtaactttcagatcaatggccgtgacgtcttagtaccattagttgtggaggaacctagtatcgttgctgcagcctcttacatggcaaagttagctagagccaatggtgggttcactacatcttcatctgctccactaatgcatgcacaagtacaaattgtcggcattcaggatccactaaacgcaagattgtctttactgcgtagaaaggatgagatcatagaattagccaataggaaggaccaacttctgaattcattgggcggtggttgcagagacatagaggtgcatacatttgccgatactccaagaggaccaatgcttgtagcacaccttattgtcgatgtgcgtgatgccatgggagctaatactgttaacactatggctgaagcagtagcacctctgatggaagccataacaggtggccaggtaagattgagaatcctttccaatttggctgatcttagattggccagagcccaagtgagaatcactcctcagcaattggaaactgccgaattctcaggtgaggcagtaattgagggtatcttggacgcatatgcttttgccgctgtggacccttacagagccgctacccacaacaaaggcataatgaacggtatcgatcctttgatcgtcgctacaggaaatgattggagagctgttgaggcaggagctcatgcatacgcttgtagatccggacattacggttcattaacaacatgggaaaaagataacaatggacacttggtcgggacattggaaatgcctatgccagttggtttagttgggggtgctacaaaaacccatcctcttgctcaattgtctttgaggatacttggtgtcaaaactgctcaagcactagccgaaattgccgttgctgttggtttggcacaaaacttgggtgcaatgcgtgctttagctacagaaggcatccaaagaggacatatggctctacacgctagaaacattgcagttgttgcaggagccagaggtgatgaggttgattgggtggctagacaacttgtcgaatatcatgatgtcagagcagacagggctgtggcattactgaaacagaagagaggtcaataa

SEQ ID NO: 120 - protein, 428 aa, Pseudomonas mevalonii
MSLDSRLPAFRNLSPAARLDHIGQLLGLSHDDVSLLANAGALPMDIANGMIENVIGTFELPYAVASNFQINGRDVLVPLVVEEPSIVAAASYMAKLARANGGFTTSSSAPLMHAQVQIVGIQDPLNARLSLLRRKDEIIELANRKDQLLNSLGGGCRDIEVHTFADTPRGPMLVAHLIVDVRDAMGANTVNTMAEAVAPLMEAITGGQVRLRILSNLADLRLARAQVRITPQQLETAEFSGEAVIEGILDAYAFAAVDPYRAATHNKGIMNGIDPLIVATGNDWRAVEAGAHAYACRSGHYGSLTTWEKDNNGHLVGTLEMPMPVGLVGGATKTHPLAQLSLRILGVKTAQALAEIAVAVGLAQNLGAMRALATEGIQRGHMALHARNIAVVAGARGDEVDWVARQLVEYHDVRADRAVALLKQKRGQ

SEQ ID NO: 121 - protein, 361 aa, Stevia rebaudiana
MALVNPTALFYGTSIRTRPTNLLNPTQKLRPVSSSSLPSFSSVSAILTEKHQSNPSENNNLQTHLETPFNFDSYMLEKVNMVNEALDASVPLKDPIKIHESMRYSLLAGGKRIRPMMCIAACEIVGGNILNAMPAACAVEMIHTMSLVHDDLPCMDNDDFRRGKPISHKVYGEEMAVLTGDALLSLSFEHIATATKGVSKDRIVRAIGELARSVGSEGLVAGQVVDILSEGADVGLDHLEYIHIHKTAMLLESSVVIGAIMGGGSDQQIEKLRKFARSIGLLFQVVDDILDVTKSTEELGKTAGKDLLTDKTTYPKLLGIEKSREFAEKLNKEAQEQLSGFDRRKAAPLIALANYNAYRQN

SEQ ID NO: 122 - protein, 342 aa, Gibberella fujikuroi
MAEQQISNLLSMFDASHASQKLEITVQMMDTYHYRETPPDSSSSEGGSLSRYDERRVSLPLSHNAASPDIVSQLCFSTAMSSELNHRWKSQRLKVADSPYNYILTLPSKGIRGAFIDSLNVWLEVPEDETSVIKEVIGMLHNSSLIIDDFQDNSPLRRGKPSTHTVFGPAQAINTATYVIVKAIEKIQDIVGHDALADVTGTITTIFQGQAMDLWWTANAIVPSIQEYLLMVNDKTGALFRLSLELLALNSEASISDSALESLSSAVSLLGQYFQIRDDYMNLIDNKYTDQKGFCEDLDEGKYSLTLIHALQTDSSDLLTNILSMRRVQGKLTAQKRCWFWK

SEQ ID NO: 123 - protein, 300 aa, Mus musculus
MEKTKEKAERILLEPYRYLLQLPGKQVRSKLSQAFNHWLKVPEDKLQIIIEVTEMLHNASLLIDDIEDSSKLRRGFPVAHSIYGVPSVINSANYVYFLGLEKVLTLDHPDAVKLFTRQLLELHQGQGLDIYWRDTYTCPTEEEYKAMVLQKTGGLFGLAVGLMQLFSDYKEDLKPLLDTLGLFFQIRDDYANLHSKEYSENKSFCEDLTEGKFSFPTIHAIWSRPESTQVQNILRQRTENIDIKKYCVQYLEDVGSFAYTRHTLRELEAKAYKQIEACGGNPSLVALVKHLSKMFTEENK

SEQ ID NO: 124 - protein, 339 aa, Thalassiosira pseudonana
MARFYFLNALLMVISLQSTTAFTPAKLAYPTTTTALNVASAETSFSLDEYLASKIGPIESALEASVKSRIPQTDKICESMAYSLMAGGKRIRPVLCIAACEMFGGSQDVAMPTAVALEMIHTMSLIHDDLPSMDNDDLRRGKPTNHVVFGEDVAILAGDSLLSTSFEHVARETKGVSAEKIVDVIARLGKSVGAEGLAGGQVMDLECEAKPGTTLDDLKWIHIHKTATLLQVAVASGAVLGGATPEEVAACELFAMNIGLAFQVADDILDVTASSEDLGKTAGKDEATDKTTYPKLLGLEESKAYARQLIDEAKESLAPFGDRAAPLLAIADFIIDRKN

SEQ ID NO: 125 - protein, 355 aa, Streptomyces clavuligerus
MHLAPRRVPRGRRSPPDRVPERQGALGRRRGAGSTGCARAAAGVHRRRGGGEADPSAAVHRGWQAGGGTGLPDEVVSTAAALEMFHAFALIHDDIMDDSATRRGSPTVHRALADRLGAALDPDQAGQLGVSTAILVGDLALTWSDELLYAPLTPHRLAAVLPLVTAMRAETVHGQYLDITSARRPGTDTSLALRIARYKTAAYTMERPLHIGAALAGARPELLAGLSAYALPAGEAFQLADDLLGVFGDPRRTGKPDLDDLRGGKHTVLVALAREHATPEQRHTLDTLLGTPGLDRQGASRLRCVLVATGARAEAERLITERRDQALTALNALTLPPPLAEALARLTLGSTAHPA

SEQ ID NO: 126 - protein, 330 aa, Sulfulobus acidicaldarius
MSYFDNYFNEIVNSVNDIIKSYISGDVPKLYEASYHLFTSGGKRLRPLILTISSDLFGGQRERAYYAGAAIEVLHTFTLVHDDIMDQDNIRRGLPTVHVKYGLPLAILAGDLLHAKAFQLLTQALRGLPSETIIKAFDIFTRSIIIISEGQAVDMEFEDRIDIKEQEYLDMISRKTAALFSASSSIGALIAGANDNDVRLMSDFGTNLGIAFQIVDDILGLTADEKELGKPVFSDIREGKKTILVIKTLELCKEDEKKIVLKALGNKSASKEELMSSADIIKKYSLDYAYNLAEKYYKNAIDSLNQVSSKSDIPGKALKYLAEFTIRRRK

SEQ ID NO: 127 - protein, 297 aa, Synechococcus sp.
MVAQTFNLDTYLSQRQQQVEEALSAALVPAYPERIYEAMRYSLLAGGKRLRPILCLAACELAGGSVEQAMPTACALEMIHTMSLIHDDLPAMDNDDFRRGKPTNHKVFGEDIAILAGDALLAYAFEHIASQTRGVPPQLVLQVIARIGHAVAATGLVGGQVVDLESEGKAISLETLEYIHSHKTGALLEASVVSGGILAGADEELLARLSHYARDIGLAFQIVDDILDVTATSEQLGKTAGKDQAAAKATYPSLLGLEASRQKAEELIQSAKEALRPYGSQAEPLLALADFITRRQH

SEQ ID NO: 128 - protein, 371 aa, Arabidopsis thaliana
MASVTLGSWIVVHHHNHHHPSSILTKSRSRSCPITLTKPISFRSKRTVSSSSSIVSSSVVTKEDNLRQSEPSSFDFMSYIITKAELVNKALDSAVPLREPLKIHEAMRYSLLAGGKRVRPVLCIAACELVGGEESTAMPAACAVEMIHTMSLIHDDLPCMDNDDLRRGKPTNHKVFGEDVAVLAGDALLSFAFEHLASATSSDVVSPVRVVRAVGELAKAIGTEGLVAGQVVDISSEGLDLNDVGLEHLEFIHLHKTAALLEASAVLGAIVGGGSDDEIERLRKFARCIGLLFQVVDDILDVTKSSKELGKTAGKDLIADKLTYPKIMGLEKSREFAEKLNREARDQLLGFDSDKVAPLLALANYIAYRQN

SEQ ID NO: 129 - protein, 787 aa, Stevia rebaudiana
MKTGFISPATVFHHRISPATTFRHHLSPATTNSTGIVALRDINFRCKAVSKEYSDLLQKDEASFTKWDDDKVKDHLDTNKNLYPNDEIKEFVESVKAMFGSMNDGEINVSAYDTAWVALVQDVDGSGSPQFPSSLEWIANNQLSDGSWGDHLLFSAHDRIINTLACVIALTSWNVHPSKCEKGLNFLRENICKLEDENAEHMPIGFEVTFPSLIDIAKKLNIEVPEDTPALKEIYARRDIKLTKIPMEVLHKVPTTLLHSLEGMPDLEWEKLLKLQCKDGSFLFSPSSTAFALMQTKDEKCLQYLTNIVTKFNGGVPNVYPVDLFEHIWVVDRLQRLGIARYFKSEIKDCVEYINKYWTKNGICWARNTHVQDIDDTAMGFRVLRAHGYDVTPDVFRQFEKDGKFVCFAGQSTQAVTGMFNVYRASQMLFPGERILEDAKKFSYNYLKEKQSTNELLDKWIIAKDLPGEVGYALDIPWYASLPRLETRYYLEQYGGEDDVWIGKTLYRMGYVSNNTYLEMAKLDYNNYVAVLQLEWYTIQQWYVDIGIEKFESDNIKSVLVSYYLAAASIFEPERSKERIAWAKTTILVDKITSIFDSSQSSKEDITAFIDKFRNKSSSKKHSINGEPWHEVMVALKKTLHGFALDALMTHSQDIHPQLHQAWEMWLTKLQDGVDVTAELMVQMINMTAGRWVSKELLTHPQYQRLSTVTNSVCHDITKLHNFKENSTTVDSKVQELVQLVFSDTPDDLDQDMKQTFLTVMKTFYYKAWCDPNTINDHISKVFEIVI

SEQ ID NO: 130 - protein, 527 aa, Streptomyces clavuligerus
MPDAHDAPPPQIRQRTLVDEATQLLTESAEDAWGEVSVSEYETARLVAHATWLGGHATRVAFLLERQHEDGSWGPPGGYRLVPTLSAVHALLTCLASPAQDHGVPHDRLLRAVDAGLTALRRLGTSDSPPDTIAVELVIPSLLEGIQHLLDPAHPHSRPAFSQHRGSLVCPGGLDGRTLGALRSHAAAGTPVPGKVWHASETLGLSTEAASHLQPAQGIIGGSAAATATWLTRVAPSQQSDSARRYLEELQHRYSGPVPSITPITYFERAWLLNNFAAAGVPCEAPAALLDSLEAALTPQGAPAGAGLPPDADDTAAVLLALATHGRGRRPEVLMDYRTDGYFQCFIGERTPSISTNAHVLETLGHHVAQHPQDRARYGSAMDTASAWLLAAQKQDGSWLDKWHASPYYATVCCTQALAAHASPATAPARQRAVRWVLATQRSDGGWGLWHSTVEETAYALQILAPPSGGGNIPVQQALTRGRARLCGALPLTPLWHDKDLYTPVRVVRAARAAALYTTRDLLLPPL

SEQ ID NO: 131 - protein, 516 aa, Bradyrhizobium japonicum
MNALSEHILSELRRLLSEMSDGGSVGPSVYDTAQALRFHGNVTGRQDAYAWLIAQQQADGGWGSADFPLFRHAPTWAALLALQRADPLPGAADAVQTATRFLQRQPDPYAHAVPEDAPIGAELILPQFCGEAAWLLGGVAFPRHPALLPLRQACLVKLGAVAMLPSGHPLLHSWEAWGTSPTTACPDDDGSIGISPAATAAWRAQAVTRGSTPQVGRADAYLQMASRATRSGIEGVFPNVWPINVFEPCWSLYTLHLAGLFAHPALAEAVRVIVAQLEARLGVHGLGPALHFAADADDTAVALCVLHLAGRDPAVDALRHFEIGELFVTFPGERNASVSTNIHALHALRLLGKPAAGASAYVEANRNPHGLWDNEKWHVSWLYPTAHAVAALAQGKPQWRDERALAALLQAQRDDGGWGAGRGSTFEETAYALFALHVMDGSEEATGRRRIAQVVARALEWMLARHAAHGLPQTPLWIGKELYCPTRVVRVAELAGLWLALRWGRRVLAEGAGAAP

SEQ ID NO: 132 - protein, 784 aa, Stevia rebaudiana
MNLSLCIASPLLTKSNRPAALSAIHTASTSHGGQTNPTNLIIDTTKERIQKQFKNVEISVSSYDTAWVAMVPSPNSPKSPCFPECLNWLINNQLNDGSWGLVNHTHNHNHPLLKDSLSSTLACIVALKRWNVGEDQINKGLSFIESNLASATEKSQPSPIGFDIIFPGLLEYAKNLDINLLSKQTDFSLMLHKRELEQKRCHSNEMDGYLAYISEGLGNLYDWNMVKKYQMKNGSVFNSPSATAAAFINHQNPGCLNYLNSLLDKFGNAVPTVYPHDLFIRLSMVDTIERLGISHHFRVEIKNVLDETYRCWVERDEQIFMDVVTCALAFRLLRINGYEVSPDPLAEITNELALKDEYAALETYHASHILYQEDLSSGKQILKSADFLKEIISTDSNRLSKLIHKEVENALKFPINTGLERINTRRNIQLYNVDNTRILKTTYHSSNISNTDYLRLAVEDFYTCQSIYREELKGLERWVVENKLDQLKFARQKTAYCYFSVAATLSSPELSDARISWAKNGILTTVVDDFFDIGGTIDELTNLIQCVEKWNVDVDKDCCSEHVRILFLALKDAICWIGDEAFKWQARDVTSHVIQTWLELMNSMLREAIWTRDAYVPTLNEYMENAYVSFALGPIVKPAIYFVGPKLSEEIVESSEYHNLFKLMSTQGRLLNDIHSFKREFKEGKLNAVALHLSNGESGKVEEEVVEEMMMMIKNKRKELMKLIFEENGSIVPRACKDAFWNMCHVLNFFYANDDGFTGNTILDTVKDIIYNPLVLVNENEEQR

SEQ ID NO: 133 - protein, 784 aa, Stevia rebaudiana
MNLSLCIASPLLTKSSRPTALSAIHTASTSHGGQTNPTNLIIDTTKERIQKLFKNVEISVSSYDTAWVAMVPSPNSPKSPCFPECLNWLINNQLNDGSWGLVNHTHNHNHPLLKDSLSSTLACIVALKRWNVGEDQINKGLSFIESNLASATDKSQPSPIGFDIIFPGLLEYAKNLDINLLSKQTDFSLMLHKRELEQKRCHSNEIDGYLAYISEGLGNLYDWNMVKKYQMKNGSVFNSPSATAAAFINHQNPGCLNYLNSLLDKFGNAVPTVYPLDLYIRLSMVDTIERLGISHHFRVEIKNVLDETYRCWVERDEQIFMDVVTCALAFRLLRIHGYKVSPDQLAEITNELAFKDEYAALETYHASQILYQEDLSSGKQILKSADFLKGILSTDSNRLSKLIHKEVENALKFPINTGLERINTRRNIQLYNVDNTRILKTTYHSSNISNTYYLRLAVEDFYTCQSIYREELKGLERWVVQNKLDQLKFARQKTAYCYFSVAATLSSPELSDARISWAKNGILTTVVDDFFDIGGTIDELTNLIQCVEKWNVDVDKDCCSEHVRILFLALKDAICWIGDEAFKWQARDVTSHVIQTWLELMNSMLREAIWTRDAYVPTLNEYMENAYVSFALGPIVKPAIYFVGPKLSEEIVESSEYHNLFKLMSTQGRLLNDIHSFKREFKEGKLNAVALHLSNGESGKVEEEVVEEMMMMIKNKRKELMKLIFEENGSIVPRACKDAFWNMCHVLNFFYANDDGFTGNTILDTVKDIIYNPLVLVNENEEQR

SEQ ID NO: 134 - protein, 590 aa, Zea mays
MAMPVKLTPASLSLKAVCCRFSSGGHALRFGSSLPCWRRTPTQRSTSSSTTRPAAEVSSGKSKQHDQEASEATIRQQLQLVDVLENMGISRHFAAEIKCILDRTYRSWLQRHEEIMLDTMTCAMAFRILRLNGYNVSSDELYHVVEASGLHNSLGGYLNDTRTLLELHKASTVSISEDESILDSIGSRSRTLLREQLESGGALRKPSLFKEVEHALDGPFYTTLDRLHHRWNIENFNIIEQHMLETPYLSNQHTSRDILALSIRDFSSSQFTYQQELQHLESWVKECRLDQLQFARQKLAYFYLSAAGTMFSPELSDARTLWAKNGVLTTIVDDFFDVAGSKEELENLVMLVEMWDEHHKVEFYSEQVEIIFSSIYDSVNQLGEKASLVQDRSITKHLVEIWLDLLKSMMTEVEWRLSKYVPTEKEYMINASLIFGLGPIVLPALYFVGPKISESIVKDPEYDELFKLMSTCGRLLNDVQTFEREYNEGKLNSVSLLVLHGGPMSISDAKRKLQKPIDTCRRDLLSLVLREESVVPRPCKELFWKMCKVCYFFYSTTDGFSSQVERAKEVDAVINEPLKLQGSHTLVSDV

SEQ ID NO: 135 - protein, 743 aa, Populus trichocarpa
MQNFHGTKERIKKMFDKIELSVSSYDTAWVAMVPSPDCPETPCFPECTKWILENQLGDGSWSLPHGNPLLVKDALSSTLACILALKRWGIGEEQINKGLRFIELNSASVTDNEQHKPIGFDIIFPGMIEYAIDLDLNLPLKPTDINSMLHRRALELTSGGGKNLEGRRAYLAYVSEGIGKLQDWEMAMKYQRKNGSLFNSPSTTAAAFIHIQDAECLHYIRSLLQKFGNAVPTIYPLDIYARLSMVDALERLGIDRHFRKERKFVLDETYRFWLQGEEEIFSDNATCALAFRILRLNGYDVSLEDHFSNSLGGYLKDSGAALELYRALQLSYPDESLLEKQNSRTSYFLKQGLSNVSLCGDRLRKNIIGEVHDALNFSDHANLQRLAIRRRIKHYATDDTRILKTSYRCSTIGNQDFLKLAVEDFNICQSIQREEFKHIERWVVERRLDKLKFARQKEAYCYFSAAATLFAPELSDARMSWAKNGVLTTVVDDFFDVGGSEEELVNLIELIERWDVNGSADFCSEEVEIIYSAIHSTISEIGDKSFGWQGRDVKSQVIKIWLDLLKSMLTEAQWSSNKSVPTLDEYMTTAHVSFALGPIVLPALYFVGPKLSEEVAGHPELLNLYKVTSTCGRLLNDWRSFKRESEEGKLNAISLYMIHSGGASTEEETIEHFKGLIDSQRRQLLQLVLQEKDSIIPRPCKDLFWNMIKLLHTFYMKDDGFTSNEMRNVVKAIINEPISLDEL

SEQ ID NO: 136 - protein, 983 aa, Phomopsis amygdali
MEFDEPLVDEARSLVQRTLQDYDDRYGFGTMSCAAYDTAWVSLVTKTVDGRKQWLFPECFEFLLETQSDAGGWEIGNSAPIDGILNTAASLLALKRHVQTEQIIQPQHDHKDLAGRAERAAASLRAQLAALDVSTTEHVGFEIIVPAMLDPLEAEDPSLVFDFPARKPLMKIHDAKMSRFRPEYLYGKQPMTALHSLEAFIGKIDFDKVRHHRTHGSMMGSPSSTAAYLMHASQWDGDSEAYLRHVIKHAAGQGTGAVPSAFPSTHFESSWILTTLFRAGFSASHLACDELNKLVEILEGSFEKEGGAIGYAPGFQADVDDTAKTISTLAVLGRDATPRQMIKVFEANTHFRTYPGERDPSLTANCNALSALLHQPDAAMYGSQIQKITKFVCDYWWKSDGKIKDKWNTCYLYPSVLLVEVLVDLVSLLEQGKLPDVLDQELQYRVAITLFQACLRPLLDQDAEGSWNKSIEATAYGILILTEARRVCFFDRLSEPLNEAIRRGIAFADSMSGTEAQLNYIWIEKVSYAPALLTKSYLLAARWAAKSPLGASVGSSLWTPPREGLDKHVRLFHQAELFRSLPEWELRASMIEAALFTPLLRAHRLDVFPRQDVGEDKYLDVVPFFWTAANNRDRTYASTLFLYDMCFIAMLNFQLDEFMEATAGILFRDHMDDLRQLIHDLLAEKTSPKSSGRSSQGTKDADSGIEEDVSMSDSASDSQDRSPEYDLVFSALSTFTKHVLQHPSIQSASVWDRKLLAREMKAYLLAHIQQAEDSTPLSELKDVPQKTDVTRVSTSTTTFFNWVRTTSADHISCPYSFHFVACHLGAALSPKGSNGDCYPSAGEKFLAAAVCRHLATMCRMYNDLGSAERDSDEGNLNSLDFPEFADSAGNGGIEIQKAALLRLAEFERDSYLEAFRRLQDESNRVHGPAGGDEARLSRRRMAILEFFAQQVDLYGQVYVIRDISARIPKNEVEKKRKLDDAFN

SEQ ID NO: 137 - protein, 881 aa, Physcomitrella patens
MASSTLIQNRSCGVTSSMSSFQIFRGQPLRFPGTRTPAAVQCLKKRRCLRPTESVLESSPGSGSYRIVTGPSGINPSSNGHLQEGSLTHRLPIPMEKSIDNFQSTLYVSDIWSETLQRTECLLQVTENVQMNEWIEEIRMYFRNMTLGEISMSPYDTAWVARVPALDGSHGPQFHRSLQWIIDNQLPDGDWGEPSLFLGYDRVCNTLACVIALKTWGVGAQNVERGIQFLQSNIYKMEEDDANHMPIGFEIVFPAMMEDAKALGLDLPYDATILQQISAEREKKMKKIPMAMVYKYPTTLLHSLEGLHREVDWNKLLQLQSENGSFLYSPASTACALMYTKDVKCFDYLNQLLIKFDHACPNVYPVDLFERLWMVDRLQRLGISRYFEREIRDCLQYVYRYWKDCGIGWASNSSVQDVDDTAMAFRLLRTHGFDVKEDCFRQFFKDGEFFCFAGQSSQAVTGMFNLSRASQTLFPGESLLKKARTFSRNFLRTKHENNECFDKWIITKDLAGEVEYNLTFPWYASLPRLEHRTYLDQYGIDDIWIGKSLYKMPAVTNEVFLKLAKADFNMCQALHKKELEQVIKWNASCQFRDLEFARQKSVECYFAGAATMFEPEMVQARLVWARCCVLTTVLDDYFDHGTPVEELRVFVQAVRTWNPELINGLPEQAKILFMGLYKTVNTIAEEAFMAQKRDVHHHLKHYWDKLITSALKEAEWAESGYVPTFDEYMEVAEISVALEPIVCSTLFFAGHRLDEDVLDSYDYHLVMHLVNRVGRILNDIQGMKREASQGKISSVQIYMEEHPSVPSEAMAIAHLQELVDNSMQQLTYEVLRFTAVPKSCKRIHLNMAKIMHAFYKDTDGFSSLTAMTGFVKKVLFEPVPE

SEQ ID NO: 138 - protein, 513 aa, Stevia rebaudiana
MDAVTGLLTVPATAITIGGTAVALAVALIFWYLKSYTSARRSQSNHLPRVPEVPGVPLLGNLLQLKEKKPYMTFTRWAATYGPIYSIKTGATSMVVVSSNEIAKEALVTRFQSISTRNLSKALKVLTADKTMVAMSDYDDYHKTVKRHILTAVLGPNAQKKHRIHRDIMMDNISTQLHEFVKNNPEQEEVDLRKIFQSELFGLAMRQALGKDVESLYVEDLKITMNRDEIFQVLVVDPMMGAIDVDWRDFFPYLKWVPNKKFENTIQQMYIRREAVMKSLIKEHKKRIASGEKLNSYIDYLLSEAQTLTDQQLLMSLWEPIIESSDTTMVTTEWAMYELAKNPKLQDRLYRDIKSVCGSEKITEEHLSQLPYITAIFHETLRRHSPVPIIPLRHVHEDTVLGGYHVPAGTELAVNIYGCNMDKNVWENPEEWNPERFMKENETIDFQKTMAFGGGKRVCAGSLQALLTASIGIGRMVQEFEWKLKDMTQEEVNTIGLTTQMLRPLRAIIKPRI

SEQ ID NO: 139 - protein, 509 aa, Arabidopsis thaliana
MAFFSMISILLGFVISSFIFIFFFKKLLSFSRKNMSEVSTLPSVPVVPGFPVIGNLLQLKEKKPHKTFTRWSEIYGPIYSIKMGSSSLIVLNSTETAKEAMVTRFSSISTRKLSNALTVLTCDKSMVATSDYDDFHKLVKRCLLNGLLGANAQKRKRHYRDALIENVSSKLHAHARDHPQEPVNFRAIFEHELFGVALKQAFGKDVESIYVKELGVTLSKDEIFKVLVHDMMEGAIDVDWRDFFPYLKWIPNKSFEARIQQKHKRRLAVMNALIQDRLKQNGSESDDDCYLNFLMSEAKTLTKEQIAILVWETIIETADTTLVTTEWAIYELAKHPSVQDRLCKEIQNVCGGEKFKEEQLSQVPYLNGVFHETLRKYSPAPLVPIRYAHEDTQIGGYHVPAGSEIAINIYGCNMDKKRWERPEDWWPERFLDDGKYETSDLHKTMAFGAGKRVCAGALQASLMAGIAIGRLVQEFEWKLRDGEEENVDTYGLTSQKLYPLMAIINPRRS

SEQ ID NO: 140 - protein, 525 aa, Gibberella fujikoroi
MSKSNSMNSTSHETLFQQLVLGLDRMPLMDVHWLIYVAFGAWLCSYVIHVLSSSSTVKVPVVGYRSVFEPTWLLRLRFVWEGGSIIGQGYNKFKDSIFQVRKLGTDIVIIPPNYIDEVRKLSQDKTRSVEPFINDFAGQYTRGMVFLQSDLQNRVIQQRLTPKLVSLTKVMKEELDYALTKEMPDMKNDEWVEVDISSIMVRLISRISARVFLGPEHCRNQEWLTTTAEYSESLFITGFILRVVPHILRPFIAPLLPSYRTLLRNVSSGRRVIGDIIRSQQGDGNEDILSWMRDAATGEEKQIDNIAQRMLILSLASIHTTAMTMTHAMYDLCACPEYIEPLRDEVKSVVGASGWDKTALNRFHKLDSFLKESQRFNPVFLLTFNRIYHQSMTLSDGTNIPSGTRIAVPSHAMLQDSAHVPGPTPPTEFDGFRYSKIRSDSNYAQKYLFSMTDSSNMAFGYGKYACPGRFYASNEMKLTLAILLLQFEFKLPDGKGRPRNITIDSDMIPDPRARLCVRKRSLRDE

SEQ ID NO: 141 - protein, 499 aa, Trametes versicolor
MEDPTVLYACLAIAVATFVVRWYRDPLRSIPTVGGSDLPILSYIGALRWTRRGREILQEGYDGYRGSTFKIAMLDRWIVIANGPKLADEVRRRPDEELNFMDGLGAFVQTKYTLGEAIHNDPYHVDIIREKLTRGLPAVLPDVIEELTLAVRQYIPTEGDEWVSVNCSKAARDIVARASNRVFVGLPACRNQGYLDLAIDFTLSVVKDRAIINMFPELLKPIVGRVVGNATRNVRRAVPFVAPLVEERRRLMEEYGEDWSEKPNDMLQWIMDEAASRDSSVKAIAERLLMVNFAAIHTSSNTITHALYHLAEMPETLQPLREEIEPLVKEEGWTKAAMGKMWWLDSFLRESQRYNGINIVSLTRMADKDITLSDGTFLPKGTLVAVPAYSTHRDDAVYADALVFDPFRFSRMRAREGEGTKHQFVNTSVEYVPFGHGKHACPGRFFAANELKAMLAYIVLNYDVKLPGDGKRPLNMYWGPTVLPAPAGQVLFRKRQVSL

SEQ ID NO: 142 - protein, 525 aa, Stevia rebaudiana
MGLFPLEDSYALVFEGLAITLALYYLLSFIYKTSKKTCTPPKASGEIIPITGIILNLLSGSSGLPIILALASLADRCGPIFTIRLGIRRVLVVSNWEIAKEIFTTHDLIVSNRPKYLAAKILGFNYVSFSFAPYGPYWVGIRKIIATKLMSSSRLQKLQFVRVFELENSMKSIRESWKEKKDEEGKVLVEMKKWFWELNMNIVLRTVAGKQYTGTVDDADAKRISELFREWFHYTGRFVVGDAFPFLGWLDLGGYKKTMELVASRLDSMVSKWLDEHRKKQANDDKKEDMDFMDIMISMTEANSPLEGYGTDTIIKTTCMTLIVSGVDTTSIVLTWALSLLLNNRDTLKKAQEELDMCVGKGRQVNESDLVNLIYLEAVLKEALRLYPAAFLGGPRAFLEDCTVAGYRIPKGTCLLINMWKLHRDPNIWSDPCEFKPERFLTPNQKDVDVIGMDFELIPFGAGRRYCPGTRLALQMLHIVLATLLQNFEMSTPNDAPVDMTASVGMTNAKASPLEVLLSPRVKWS

SEQ ID NO: 143 - protein, 476 aa, Stevia rebaudiana
MIQVLTPILLFLIFFVFWKVYKHQKTKINLPPGSFGWPFLGETLALLRAGWDSEPERFVRERIKKHGSPLVFKTSLFGDRFAVLCGPAGNKFLFCNENKLVASWWPVPVRKLFGKSLLTIRGDEAKWMRKMLLSYLGPDAFATHYAVTMDVVTRRHIDVHWRGKEEVNVFQTVKLYAFELACRLFMNLDDPNHIAKLGSLFNIFLKGIIELPIDVPGTRFYSSKKAAAAIRIELKKLIKARKLELKEGKASSSQDLLSHLLTSPDENGMFLTEEEIVDNILLLLFAGHDTSALSITLLMKTLGEHSDVYDKVLKEQLEISKTKEAWESLKWEDIQKMKYSWSVICEVMRLNPPVIGTYREALVDIDYAGYTIPKGWKLHWSAVSTQRDEANFEDVTRFDPSRFEGAGPTPFTFVPFGGGPRMCLGKEFARLEVLAFLHNIVTNFKWDLLIPDEKIEYDPMATPAKGLPIRLHPHQV

SEQ ID NO: 144 - protein, 525 aa, Arabidopsis thaliana
MESLVVHTVNAIWCIVIVGIFSVGYHVYGRAVVEQWRMRRSLKLQGVKGPPPSIFNGNVSEMQRIQSEAKHCSGDNIISHDYSSSLFPHFDHWRKQYGRIYTYSTGLKQHLYINHPEMVKELSQTNTLNLGRITHITKRLNPILGNGIITSNGPHWAHQRRIIAYEFTHDKIKGMVGLMVESAMPMLNKWEEMVKRGGEMGCDIRVDEDLKDVSADVIAKACFGSSFSKGKAIFSMIRDLLTAITKRSVLFRFNGFTDMVFGSKKHGDVDIDALEMELESSIWETVKEREIECKDTHKKDLMQLILEGAMRSCDGNLWDKSAYRRFVVDNCKSIYFAGHDSTAVSVSWCLMLLALNPSWQVKIRDEILSSCKNGIPDAESIPNLKTVTMVIQETMRLYPPAPIVGREASKDIRLGDLVVPKGVCIWTLIPALHRDPEIWGPDANDFKPERFSEGISKACKYPQSYIPFGLGPRTCVGKNFGMMEVKVLVSLIVSKFSFTLSPTYQHSPSHKLLVEPQHGVVIRVV

SEQ ID NO: 145 - protein, 529 aa, Vitis vinifera
MYFLLQYLNITTVGVFATLFLSYCLLLWRSRAGNKKIAPEAAAAWPIIGHLHLLAGGSHQLPHITLGNMADKYGPVFTIRIGLHRAVVVSSWEMAKECSTANDQVSSSRPELLASKLLGYNYAMFGFSPYGSYWREMRKIISLELLSNSRLELLKDVRASEVVTSIKELYKLWAEKKNESGLVSVEMKQWFGDLTLNVILRMVAGKRYFSASDASENKQAQRCRRVFREFFHLSGLFVVADAIPFLGWLDWGRHEKTLKKTAIEMDSIAQEWLEEHRRRKDSGDDNSTQDFMDVMQSVLDGKNLGGYDADTINKATCLTLISGGSDTTVVSLTWALSLVLNNRDTLKKAQEELDIQVGKERLVNEQDISKLVYLQAIVKETLRLYPPGPLGGLRQFTEDCTLGGYHVSKGTRLIMNLSKIQKDPRIWSDPTEFQPERFLTTHKDVDPRGKHFEFIPFGAGRRACPGITFGLQVLHLTLASFLHAFEFSTPSNEQVNMRESLGLTNMKSTPLEVLISPRLSLNCFNLMKI

SEQ ID NO: 146 - protein, 479 aa, Medicago trunculata
MEPNFYLSLLLLFVTFISLSLFFIFYKQKSPLNLPPGKMGYPIIGESLEFLSTGWKGHPEKFIFDRMRKYSSELFKTSIVGESTVVCCGAASNKFLFSNENKLVTAWWPDSVNKIFPTTSLDSNLKEESIKMRKLLPQFFKPEALQRYVGVMDVIAQRHFVTHWDNKNEITVYPLAKRYTFLLACRLFMSVEDENHVAKFSDPFQLIAAGIISLPIDLPGTPFNKAIKASNFIRKELIKIIKQRRVDLAEGTASPTQDILSHMLLTSDENGKSMNELNIADKILGLLIGGHDTASVACTFLVKYLGELPHIYDKVYQEQMEIAKSKPAGELLNWDDLKKMKYSWNVACEVMRLSPPLQGGFREAITDFMFNGFSIPKGWKLYWSANSTHKNAECFPMPEKFDPTRFEGNGPAPYTFVPFGGGPRMCPGKEYARLEILVFMHNLVKRFKWEKVIPDEKIIVDPFPIPAKDLPIRLYPHKA

SEQ ID NO: 147 - protein, 710 aa, Stevia rebaudiana
MQSDSVKVSPFDLVSAAMNGKAMEKLNASESEDPTTLPALKMLVENRELLTLFTTSFAVLIGCLVFLMWRRSSSKKLVQDPVPQVIVVKKKEKESEVDDGKKKVSIFYGTQTGTAEGFAKALVEEAKVRYEKTSFKVIDLDDYAADDDEYEEKLKKESLAFFFLATYGDGEPTDNAANFYKWFTEGDDKGEWLKKLQYGVFGLGNRQYEHFNKIAIVVDDKLTEMGAKRLVPVGLGDDDQCIEDDFTAWKELVWPELDQLLRDEDDTSVTTPYTAAVLEYRVVYHDKPADSYAEDQTHTNGHVVHDAQHPSRSNVAFKKELHTSQSDRSCTHLEFDISHTGLSYETGDHVGVYSENLSEVVDEALKLLGLSPDTYFSVHADKEDGTPIGGASLPPPFPPCTLRDALTRYADVLSSPKKVALLALAAHASDPSEADRLKFLASPAGKDEYAQWIVANQRSLLEVMQSFPSAKPPLGVFFAAVAPRLQPRYYSISSSPKMSPNRIHVTCALVYETTPAGRIHRGLCSTWMKNAVPLTESPDCSQASIFVRTSNFRLPVDPKVPVIMIGPGTGLAPFRGFLQERLALKESGTELGSSIFFFGCRNRKVDFIYEDELNNFVETGALSELIVAFSREGTAKEYVQHKMSQKASDIWKLLSEGAYLYVCGDAKGMAKDVHRTLHTIVQEQGSLDSSKAELYVKNLQMSGRYLRDVW

SEQ ID NO: 148 - protein, 692 aa, Arabidopsis thaliana [sequence omitted]

SEQ ID NO: 149 - protein, 713 aa, Giberella fujikuroi
MAELDTLDIVVLGVIFLGTVAYFTKGKLWGVTKDPYANGFAAGGASKPGRTRNIVEAMEESGKNCVVFYGSQTGTAEDYASRLAKEGKSRFGLNTMIADLEDYDFDNLDTVPSDNIVMFVLATYGEGEPTDNAVDFYEFITGEDASFNEGNDPPLGNLNYVAFGLGNNTYEHYNSMVRNVNKALEKLGAHRIGEAGEGDDGAGTMEEDFLAWKDPMWEALAKKMGLEEREAVYEPIFAINERDDLTPEANEVYLGEPNKLHLEGTAKGPFNSHNPYIAPIAESYELFSAKDRNCLHMEIDISGSNLKYETGDHIAIWPTNPGEEVNKFLDILDLSGKQHSVVTVKALEPTAKVPFPNPTTYDAILRYHLEICAPVSRQFVSTLAAFAPNDDIKAEMNRLGSDKDYFHEKTGPHYYNIARFLASVSKGEKWTKIPFSAFIEGLTKLQPRYYSISSSSLVQPKKISITAVVESQQIPGRDDPFRGVATNYLFALKQKQNGDPNPAPFGQSYELTGPRNKYDGIHVPVHVRHSNFKLPSDPGKPIIMIGPGTGVAPFRGFVQERAKQARDGVEVGKTLLFFGCRKSTEDFMYQKEWQEYKEALGDKFEMITAFSREGSKKVYVQHRLKERSKEVSDLLSQKAYFYVCGDAAHMAREVNTVLAQIIAEGRGVSEAKGEEIVKNMRSANQYQVCSDFVTLHCKETTYANSELQEDVWS

SEQ ID NO: 150 - protein, 453 aa, Arabidopsis thaliana
MGGLKFHVLMYPWFATGHMTPFLFLANKLAEKGHTVTFLLPKKSLKQLEHFNLFPHNIVFRSVTVPHVDGLPVGTETASEIPVTSTDLLMSAMDLTRDQVEAVVRAVEPDLIFFDFAHWIPEVARDFGLKTVKYVVVSASTIASMLVPGGELGVPPPGYPSSKVLLRKQDAYTMKKLEPTNTIDVGPNLLERVTTSLMNSDVIAIRTAREIEGNFCDYIEKHCRKKVLLTGPVFPEPDKTRELEERWVKWLSGYEPDSVVFCALGSQVILEKDQFQELCLGMELTGSPFLVAVKPPRGSSTIQEALPEGFEERVKGRGLVWGGWVQQPLILSHPSVGCFVSHCGFGSMWESLLSDCQIVLVPQLGDQVLNTRLLSDELKVSVEVAREETGWFSKESLCDAVNSVMKRDSELGNLVRKNHTKWRETVASPGLMTGYVDAFVESLQDLVSGTTHD

SEQ ID NO: 151 - DNA, 1362 bp, Arabidopsis thaliana
atgggtggtttgaagtttcatgtacttatgtatccatggttcgcaacaggccatatgaccccgttcctttttcttgccaacaaattggctgagaaaggtcatacggtcactttcttgcttcccaagaaatctctgaaacagttggaacatttcaatctgtttccacacaacattgtctttcgctctgtcaccgtccctcatgtggatggtctccccgttggcacagagacagcctctgagatccctgtgacatcaactgatctcttgatgtctgctatggatctcacacgtgatcaagttgaagctgtggtccgagccgttgaaccggacctgatcttctttgactttgctcattggattccagaagtagctagggacttcggccttaagactgtaaagtacgtcgtggtgtctgcatcgactatagctagtatgcttgtcccaggtggtgagttaggtgttcctccaccgggatatccatcatcaaaggtgctgcttcgtaaacaagatgcttacactatgaagaaactggagcctacaaatacaatcgatgtcggaccaaacctcttggaacgagtcactacaagtcttatgaactctgatgtcattgcgataaggacagccagagaaatcgaaggaaacttttgcgactatatagaaaaacattgcaggaaaaaggttctcttgacaggtccggtgttccctgagccagacaagactagagagctagaggaacgatgggttaagtggctaagtgggtatgaaccagactcagtggtgttttgtgcactgggctcacaagtcattttagagaaagatcaattccaagaactctgcttaggaatggagctaacaggttcaccgtttcttgtagcggttaagccccctagaggctcatcaacgattcaagaagcacttcctgaaggattcgaagagcgggttaaaggaagaggccttgtttggggaggatgggttcaacaaccattgatattgtctcatccatcagtcgggtgctttgtgagccattgtgggtttggatcaatgtgggagtctttgctgagtgattgtcagatagtcttagtaccacagttgggtgatcaagtcctgaacacaagattgctgagtgacgaactcaaggtttcggttgaagtggcaagagaggaaacaggatggttctcgaaagagagcttgtgcgatgctgtcaatagtgtgatgaaaagggacagcgagctcgggaacctggtgaggaagaatcacaccaagtggagggagacagtagctagtcctggactaatgactggttatgtcgatgctttcgtagagtcattgcaggatcttgtctctgggaccacccatgactga

SEQ ID NO: 152 - protein, 462 aa, Oryza sativa
MDSGYSSSYAAAAGMHVVICPWLAFGHLLPCLDLAQRLASRGHRVSFVSTPRNISRLPPVRPALAPLVAFVALPLPRVEGLPDGAESTNDVPHDRPDMVELHRRAFDGLAAPFSEFLGTACADWVIVDVFHHWAAAAALEHKVPCAMMLLGSAHMIASIADRRLERAETESPAAAGQGRPAAAPTFEVARMKLIRTKGSSGMSLAERFSLTLSRSSLVVGRSCVEFEPETVPLLSTLRGKPITFLGLMPPLHEGRREDGEDATVRWLDAQPAKSVVYVALGSEVPLGVEKVHELALGLELAGTRFLWALRKPTGVSDADLLPAGFEERTRGRGVVATRWVPQMSILAHAAVGAFLTHCGWNSTIEGLMFGHPLIMLPIFGDQGPNARLIEAKNAGLQVARNDGDGSFDREGVAAAIRAVAVEEESSKVFQAKAKKLQEIVADMACHERYIDGFIQQLRSYKD

SEQ ID NO: 153 - DNA, 1389 bp, Oryza sativa
atggactccggctactcctcctcctacgccgccgccgccgggatgcacgtcgtgatctgcccgtggctcgccttcggccacctgctcccgtgcctcgacctcgcccagcgcctcgcgtcgcggggccaccgcgtgtcgttcgtctccacgccgcggaacatatcccgcctcccgccggtgcgccccgcgctcgcgccgctcgtcgccttcgtggcgctgccgctcccgcgcgtcgaggggctccccgacggcgccgagtccaccaacgacgtcccccacgacaggccggacatggtcgagctccaccggagggccttcgacgggctcgccgcgcccttctcggagttcttgggcaccgcgtgcgccgactgggtcatcgtcgacgtcttccaccactgggccgcagccgccgctctcgagcacaaggtgccatgtgcaatgatgttgttgggctctgcacatatgatcgcttccatagcagacagacggctcgagcgcgcggagacagagtcgcctgcggctgccgggcagggacgcccagcggcggcgccaacgttcgaggtggcgaggatgaagttgatacgaaccaaaggctcatcgggaatgtccctcgccgagcgcttctccttgacgctctcgaggagcagcctcgtcgtcgggcggagctgcgtggagttcgagccggagaccgtcccgctcctgtcgacgctccgcggtaagcctattaccttccttggccttatgccgccgttgcatgaaggccgccgcgaggacggcgaggatgccaccgtccgctggctcgacgcgcagccggccaagtccgtcgtgtacgtcgcgctaggcagcgaggtgccactgggagtggagaaggtccacgagctcgcgctcgggctggagctcgccgggacgcgcttcctctgggctcttaggaagcccactggcgtctccgacgccgacctcctccccgccggcttcgaggagcgcacgcgcggccgcggcgtcgtggcgacgagatgggttcctcagatgagcatactggcgcacgccgccgtgggcgcgttcctgacccactgcggctggaactcgaccatcgaggggctcatgttcggccacccgcttatcatgctgccgatcttcggcgaccagggaccgaacgcgcggctaatcgaggcgaagaacgccggattgcaggtggcaagaaacgacggcgatggatcgttcgaccgagaaggcgtcgcggcggcgattcgtgcagtcgcggtggaggaagaaagcagcaaagtgtttcaagccaaagccaagaagctgcaggagatcgtcgcggacatggcctgccatgagaggtacatcgacggattcattcagcaattgagatcttacaaggattga

SEQ ID NO: 154 - DNA, 1389 bp, Artificial Sequence
  Oryza sativa sequence that has been codon optimized for yeast
atggatagtggctactcctcatcttatgctgctgccgctggtatgcacgttgtgatctgcccttggttggcctttggtcacctgttaccatgtctggatttagcccaaagactggcctcaagaggccatagagtatcatttgtgtctactcctagaaatatctctcgtttaccaccagtcagacctgctctagctcctctagttgcattcgttgctcttccacttccaagagtagaaggattgccagacggcgctgaatctactaatgacgtaccacatgatagacctgacatggtcgaattgcatagaagagcctttgatggattggcagctccattttctgagttcctgggcacagcatgtgcagactgggttatagtcgatgtatttcatcactgggctgctgcagccgcattggaacataaggtgccttgtgctatgatgttgttagggtcagcacacatgatcgcatccatagctgatagaagattggaaagagctgaaacagaatccccagccgcagcaggacaaggtaggccagctgccgccccaacctttgaagtggctagaatgaaattgattcgtactaaaggtagttcagggatgagtcttgctgaaaggttttctctgacattatctagatcatcattagttgtaggtagatcctgcgtcgagttcgaacctgaaacagtacctttactatctactttgagaggcaaacctattactttccttggtctaatgcctccattacatgaaggaaggagagaagatggtgaagatgctactgttaggtggttagatgcccaacctgctaagtctgttgtttacgttgcattgggttctgaggtaccactaggggtggaaaaggtgcatgaattagcattaggacttgagctggccggaacaagattcctttgggctttgagaaaaccaaccggtgtttctgacgccgacttgctaccagctgggttcgaagagagaacaagaggccgtggtgtcgttgctactagatgggtcccacaaatgagtattctagctcatgcagctgtaggggcctttctaacccattgcggttggaactcaacaatagaaggactgatgtttggtcatccacttattatgttaccaatctttggcgatcagggacctaacgcaagattgattgaggcaaagaacgcaggtctgcaggttgcacgtaatgatggtgatggttcctttgatagagaaggcgttgcagctgccatcagagcagtcgccgttgaggaagagtcatctaaagttttccaagctaaggccaaaaaattacaagagattgtggctgacatggcttgtcacgaaagatacatcgatggtttcatccaacaattgagaagttataaagactaa

SEQ ID NO: 155 - DNA, 2506 bp, Arabidopsis thaliana
cgtcagtcatcaaggctaattcgtcgcgagttgctacgacgccgtttcggttgcttctggtttctttatgtctatcaaccttcgctcctccggttgttcgtctccgatctcagctactttggaacgaggattggactcagaagtacagacaagagctaacaatgtgagctttgagcaaacaaaggagaagattaggaagatgttggagaaagtggagctttctgtttcggcctacgatactagttgggtagcaatggttccatcaccgagctcccaaaatgctccacttttcccacagtgtgtgaaatggttattggataatcaacatgaagatggatcttggggacttgataaccatgaccatcaatctcttaagaaggatgtgttatcatctacactggctagtatcctcgcgttaaagaagtggggaattggtgaaagacaaataaacaagggtctccagtttattgagctgaattctgcattagtcactgatgaaaccatacagaaaccaacagggtttgatattatatttcctgggatgattaaatatgctagagatttgaatctgacgattccattgggctcagaagtggtggatgacatgatacgaaaaagagatctggatcttaaatgtgatagtgaaaagttttcaaagggaagagaagcatatctggcctatgttttagaggggacaagaaacctaaaagattgggatttgatagtcaaatatcaaaggaaaaatgggtcactgtttgattctccagccacaacagcagctgcttttactcagtttgggaatgatggttgtctccgttatctctgttctctccttcagaaattcgaggctgcagttccttcagtttatccatttgatcaatatgcacgccttagtataattgtcactcttgaaagcttaggaattgatagagatttcaaaaccgaaatcaaaagcatattggatgaaacctatagatattggcttcgtggggatgaagaaatatgtttggacttggccacttgtgctttggctttccgattattgcttgctcatggctatgatgtgtcttacgatccgctaaaaccatttgcagaagaatctggtttctctgatactttggaaggatatgttaagaatacgttttctgtgttagaattatttaaggctgctcaaagttatccacatgaatcagctttgaagaagcagtgttgttggactaaacaatatctggagatggaattgtccagctgggttaagacctctgttcgagataaatacctcaagaaagaggtcgaggatgctcttgcttttccctcctatgcaagcctagaaagatcagatcacaggagaaaaatactcaatggttctgctgtggaaaacaccagagttacaaaaacctcatatcgtttgcacaatatttgcacctctgatatcctgaagttagctgtggatgacttcaatttctgccagtccatacaccgtgaagaaatggaacgtcttgataggtggattgtggagaatagattgcaggaactgaaatttgccagacagaagctggcttactgttatttctctggggctgcaactttattttctccagaactatctgatgctcgtatatcgtgggccaaaggtggagtacttacaacggttgtagacgacttctttgatgttggagggtccaaagaagaactggaaaacctcatacacttggtcgaaaagtgggatttgaacggtgttcctgagtacagctcagaacatgttgagatcatattctcagttctaagggacaccattctcgaaacaggagacaaagcattcacctatcaaggacgcaatgtgacacaccacattgtgaaaatttggttggatctgctcaagtctatgttgagagaagccgagtggtccagtgacaagtcaacaccaagcttggaggattacatggaaaatgcgtacatatcatttgcattaggaccaattgtcctcccagctacctatctgatcggacctccacttccagagaagacagtcgatagccaccaatataatcagctctacaagctcgtgagcactatgggtcgtcttctaaatgacatacaaggttttaagagagaaagcgcggaagggaagctgaatgcggtttcattgcacatgaaacacgagagagacaatcgcagcaaagaagtgatcatagaatcgatgaaaggtttagcagagagaaagagggaagaattgcataagctagttttggaggagaaaggaagtgtggttccaagggaatgcaaagaagcgttcttgaaaatgagcaaagtgttgaacttattttacaggaaggacgatggattcacatcaaatgatctgatgagtcttgttaaatcagtgatctacgagcctgttagcttacagaaagaatctttaacttgatccaagttgatctggcaggtaaactcagtaaatgaaaataagactttggtcttcttctttgttgcttcagaacaagaagag

SEQ ID NO: 156 - protein, 785 aa, Arabidopsis thaliana
MSINLRSSGCSSPISATLERGLDSEVQTRANNVSFEQTKEKIRKMLEKVELSVSAYDTSWVAMVPSPSSQNAPLFPQCVKWLLDNQHEDGSWGLDNHDHQSLKKDVLSSTLASILALKKWGIGERQINKGLQFIELNSALVTDETIQKPTGFDIIFPGMIKYARDLNLTIPLGSEVVDDMIRKRDLDLKCDSEKFSKGREAYLAYVLEGTRNLKDWDLIVKYQRKNGSLFDSPATTAAAFTQFGNDGCLRYLCSLLQKFEAAVPSVYPFDQYARLSIIVTLESLGIDRDFKTEIKSILDETYRYWLRGDEEICLDLATCALAFRLLLAHGYDVSYDPLKPFAEESGFSDTLEGYVKNTFSVLELFKAAQSYPHESALKKQCCWTKQYLEMELSSWVKTSVRDKYLKKEVEDALAFPSYASLERSDHRRKILNGSAVENTRVTKTSYRLHNICTSDILKLAVDDFNFCQSIHREEMERLDRWIVENRLQELKFARQKLAYCYFSGAATLFSPELSDARISWAKGGVLTTVVDDFFDVGGSKEELENLIHLVEKWDLNGVPEYSSEHVEIIFSVLRDTILETGDKAFTYQGRNVTHHIVKIWLDLLKSMLREAEWSSDKSTPSLEDYMENAYISFALGPIVLPATYLIGPPLPEKTVDSHQYNQLYKLVSTMGRLLNDIQGFKRESAEGKLNAVSLHMKHERDNRSKEVIIESMKGLAERKREELHKLVLEEKGSVVPRECKEAFLKMSKVLNLFYRKDDGFTSNDLMSLVKSVIYEPVSLQKESLT

SEQ ID NO: 157 - DNA, 2490 bp, Zea mays; identical to SEQ ID NO: 80

SEQ ID NO: 158 - protein, 827 aa, Zea mays; identical to SEQ ID NO: 81

SEQ ID NO: 159 - DNA, 2570 bp, Arabidopsis thaliana
cttcttcactaaatacttagacagagaaaacagagctttttaaagccatgtctcttcagtatcatgttctaaactccattccaagtacaacctttctcagttctactaaaacaacaatatcttcttctttccttaccatctcaggatctcctctcaatgtcgctagagacaaatccagaagcggttccatacattgttcaaagcttcgaactcaagaatacattaattctcaagaggttcaacatgatttgcctctaatacatgagtggcaacagcttcaaggagaagatgctcctcagattagtgttggaagtaatagtaatgcattcaaagaagcagtgaagagtgtgaaaacgatcttgagaaacctaacggacggggaaattacgatatcggcttacgatacagcttgggttgcattgatcgatgccggagataaaactccggcgtttccctccgccgtgaaatggatcgccgagaaccaactttccgatggttcttggggagatgcgtatctcttctcttatcatgatcgtctcatcaatacccttgcatgcgtcgttgctctaagatcatggaatctctttcctcatcaatgcaacaaaggaatcacgtttttccgggaaaatattgggaagctagaagacgaaaatgatgagcatatgccaatcggattcgaagtagcattcccatcgttgcttgagatagctcgaggaataaacattgatgtaccgtacgattctccggtcttaaaagatatatacgccaagaaagagctaaagcttacaaggataccaaaagagataatgcacaagataccaacaacattgttgcatagtttggaggggatgcgtgatttagattgggaaaagctcttgaaacttcaatctcaagacggatctttcctcttctctccttcctctaccgcttttgcattcatgcagacccgagacagtaactgcctcgagtatttgcgaaatgccgtcaaacgtttcaatggaggagttcccaatgtctttcccgtggatcttttcgagcacatatggatagtggatcggttacaacgtttagggatatcgagatactttgaagaagagattaaagagtgtcttgactatgtccacagatattggaccgacaatggcatatgttgggctagatgttcccatgtccaagacatcgatgatacagccatggcatttaggctcttaagacaacatggataccaagtgtccgcagatgtattcaagaactttgagaaagagggagagtttttctgctttgtggggcaatcaaaccaagcagtaaccggtatgttcaacctataccgggcatcacaattggcgtttccaagggaagagatattgaaaaacgccaaagagttttcttataattatctgctagaaaaacgggagagagaggagttgattgataagtggattataatgaaagacttacctggcgagattgggtttgcgttagagattccatggtacgcaagcttgcctcgagtagagacgagattctatattgatcaatatggtggagaaaacgacgtttggattggcaagactctttataggatgccatacgtgaacaataatggatatctggaattagcaaaacaagattacaacaattgccaagctcagcatcagctcgaatgggacatattccaaaagtggtatgaagaaaataggttaagtgagtggggtgtgcgcagaagtgagcttctcgagtgttactacttagcggctgcaactatatttgaatcagaaaggtcacatgagagaatggtttgggctaagtcaagtgtattggttaaagccatttcttcttcttttggggaatcctctgactccagaagaagcttctccgatcagtttcatgaatacattgccaatgctcgacgaagtgatcatcactttaatgacaggaacatgagattggaccgaccaggatcggttcaggccagtcggcttgccggagtgttaatcgggactttgaatcaaatgtcttttgaccttttcatgtctcatggccgtgacgttaacaatctcctctatctatcgtggggagattggatggaaaaatggaaactatatggagatgaaggagaaggagagctcatggtgaagatgataattctaatgaagaacaatgacctaactaacttcttcacccacactcacttcgttcgtctcgcggaaatcatcaatcgaatctgtcttcctcgccaatacttaaaggcaaggagaaacgatgagaaggagaagacaataaagagtatggagaaggagatggggaaaatggttgagttagcattgtcggagagtgacacatttcgtgacgtcagcatcacgtttcttgatgtagcaaaagcattttactactttgctttatgtggcgatcatctccaaactcacatctccaaagtcttgtttcaaaaagtctagtaacctcatcatcatcatcgatccattaacaatcagtggatcgatgtatccatagatgcgtgaataatatttcatgtagagaaggagaacaaattagatcatgtagggttatca

SEQ ID NO: 160 - protein, 802 aa, Arabidopsis thaliana
MSLQYHVLNSIPSTTFLSSTKTTISSSFLTISGSPLNVARDKSRSGSIHCSKLRTQEYINSQEVQHDLPLIHEWQQLQGEDAPQISVGSNSNAFKEAVKSVKTILRNLTDGEITISAYDTAWVALIDAGDKTPAFPSAVKWIAENQLSDGSWGDAYLFSYHDRLINTLACVVALRSWNLFPHQCNKGITFFRENIGKLEDENDEHMPIGFEVAFPSLLEIARGINIDVPYDSPVLKDIYAKKELKLTRIPKEIMHKIPTTLLHSLEGMRDLDWEKLLKLQSQDGSFLFSPSSTAFAFMQTRDSNCLEYLRNAVKRFNGGVPNVFPVDLFEHIWIVDRLQRLGISRYFEEEIKECLDYVHRYWTDNGICWARCSHVQDIDDTAMAFRLLRQHGYQVSADVFKNFEKEGEFFCFVGQSNQAVTGMFNLYRASQLAFPREEILKNAKEFSYNYLLEKREREELIDKWIIMKDLPGEIGFALEIPWYASLPRVETRFYIDQYGGENDVWIGKTLYRMPYVNNNGYLELAKQDYNNCQAQHQLEWDIFQKWYEENRLSEWGVRRSELLECYYLAAATIFESERSHERMVWAKSSVLVKAISSSFGESSDSRRSFSDQFHEYIANARRSDHHFNDRNMRLDRPGSVQASRLAGVLIGTLNQMSFDLFMSHGRDVNNLLYLSWGDWMEKWKLYGDEGEGELMVKMIILMKNNDLTNFFTHTHFVRLAEIINRICLPRQYLKARRNDEKEKTIKSMEKEMGKMVELALSESDTFRDVSITFLDVAKAFYYFALCGDHLQTHISKVLFQKV

SEQ ID NO: 161 - DNA, 2859 bp, Gibberella fujikuroi
atgcctggtaaaattgaaaatggtaccccaaaggacctcaagactggaaatgattttgtttctgctgctaagagtttactagatcgagctttcaaaagtcatcattcctactacggattatgctcaacttcatgtcaagtttatgatacagcttgggttgcaatgattccaaaaacaagagataatgtaaaacagtggttgtttccagaatgtttccattacctcttaaaaacacaagccgcagatggctcatggggttcattgcctacaacacagacagcgggtatcctagatacagcctcagctgtgctggcattattgtgccacgcacaagagcctttacaaatattggatgtatctccagatgaaatggggttgagaatagaacacggtgtcacatccttgaaacgtcaattagcagtttggaatgatgtggaggacaccaaccatattggcgtcgagtttatcataccagccttactttccatgctagaaaaggaattagatgttccatcttttgaatttccatgtaggtccatcttagagagaatgcacggggagaaattaggtcatttcgacctggaacaagtttacggcaagccaagctcattgttgcactcattggaagcatttctcggtaagctagattttgatcgactatcacatcacctataccacggcagtatgatggcatctccatcttcaacggctgcttatcttattggggctacaaaatgggatgacgaagccgaagattacctaagacatgtaatgcgtaatggtgcaggacatgggaatggaggtatttctggtacatttccaactactcatttcgaatgtagctggattatagcaacgttgttaaaggttggctttactttgaagcaaattgacggcgatggcttaagaggtttatcaaccatcttacttgaggcgcttcgtgatgagaatggtgtcataggctttgcccctagaacagcagatgtagatgacacagccaaagctctattggccttgtcattggtaaaccagccagtgtcacctgatatcatgattaaggtctttgagggcaaagaccattttaccacttttggttcagaaagagatccatcattgacttccaacctgcacgtccttttatctttacttaaacaatctaacttgtctcaataccatcctcaaatcctcaaaacaacattattcacttgtagatggtggtggggttccgatcattgtgtcaaagacaaatggaatttgagtcacctatatccaactatgttgttggttgaagccttcactgaagtgctccatctcattgacggtggtgaattgtctagtctgtttgatgaatcctttaagtgtaagattggtcttagcatctttcaagcggtacttagaataatcctcacccaagacaacgacggctcttggagaggatacagagaacagacgtgttacgcaatattggctttagttcaagcgagacatgtatgctttttcactcacatggttgacagactgcaatcatgtgttgatcgaggtttctcatggttgaaatcttgctcttttcattctcaagacctgacttggacctctaaaacagcttatgaagtgggtttcgtagctgaagcatataaactagctgctttacaatctgcttccctggaggttcctgctgccaccattggacattctgtcacgtctgccgttccatcaagtgatcttgaaaaatacatgagattggtgagaaaaactgcgttattctctccactggatgagtggggtctaatggcttctatcatcgaatcttcatttttcgtaccattactgcaggcacaaagagttgaaatataccctagagataatatcaaggtggacgaagataagtacttgtctattatcccattcacatgggtcggatgcaataataggtctagaactttcgcaagtaacagatggctatacgatatgatgtacctttcattactcggctatcaaaccgacgagtacatggaagctgtagctgggccagtgtttggggatgtttccttgttacatcaaacaattgataaggtgattgataatacaatgggtaaccttgcgagagccaatggaacagtacacagtggtaatggacatcagcacgaatctcctaatataggtcaagtcgaggacaccttgactcgtttcacaaattcagtcttgaatcacaaagacgtccttaactctagctcatctgatcaagatactttgagaagagagtttagaacattcatgcacgctcatataacacaaatcgaagataactcacgattcagtaagcaagcctcatccgatgcgttttcctctcctgaacaatcttactttcaatgggtgaactcaactggtggctcacatgtcgcttgcgcctattcatttgccttctctaattgcctcatgtctgcaaatttgttgcagggtaaagacgcatttccaagcggaacgcaaaagtacttaatctcctctgttatgagacatgccacaaacatgtgtagaatgtataacgactttggctctattgccagagacaacgctgagagaaatgttaatagtattcattttcctgagtttactctctgtaacggaacttctcaaaacctagatgaaaggaaggaaagacttctgaaaatcgcaacttacgaacaagggtatttggatagagcactagaggccttggaaagacagagtagagatgatgccggagacagagctggatctaaagatatgagaaagttgaaaatcgttaagttattctgtgatgttacggacttatacgatcagctctacgttatcaaagatttgtcatcctctatgaagtaa

SEQ ID NO: 162 - protein, 952 aa, Gibberella fujikuroi
MPGKIENGTPKDLKTGNDFVSAAKSLLDRAFKSHHSYYGLCSTSCQVYDTAWVAMIPKTRDNVKQWLFPECFHYLLKTQAADGSWGSLPTTQTAGILDTASAVLALLCHAQEPLQILDVSPDEMGLRIEHGVTSLKRQLAVWNDVEDTNHIGVEFIIPALLSMLEKELDVPSFEFPCRSILERMHGEKLGHFDLEQVYGKPSSLLHSLEAFLGKLDFDRLSHHLYHGSMMASPSSTAAYLIGATKWDDEAEDYLRHVMRNGAGHGNGGISGTFPTTHFECSWIIATLLKVGFTLKQIDGDGLRGLSTILLEALRDENGVIGFAPRTADVDDTAKALLALSLVNQPVSPDIMIKVFEGKDHFTTFGSERDPSLTSNLHVLLSLLKQSNLSQYHPQILKTTLFTCRWWWGSDHCVKDKWNLSHLYPTMLLVEAFTEVLHLIDGGELSSLFDESFKCKIGLSIFQAVLRIILTQDNDGSWRGYREQTCYAILALVQARHVCFFTHMVDRLQSCVDRGFSWLKSCSFHSQDLTWTSKTAYEVGFVAEAYKLAALQSASLEVPAATIGHSVTSAVPSSDLEKYMRLVRKTALFSPLDEWGLMASIIESSFFVPLLQAQRVEIYPRDNIKVDEDKYLSIIPFTWVGCNNRSRTFASNRWLYDMMYLSLLGYQTDEYMEAVAGPVFGDVSLLHQTIDKVIDNTMGNLARANGTVHSGNGHQHESPNIGQVEDTLTRFTNSVLNHKDVLNSSSSDQDTLRREFRTFMHAHITQIEDNSRFSKQASSDAFSSPEQSYFQWVNSTGGSHVACAYSFAFSNCLMSANLLQGKDAFPSGTQKYLISSVMRHATNMCRMYNDFGSIARDNAERNVNSIHFPEFTLCNGTSQNLDERKERLLKIATYEQGYLDRALEALERQSRDDAGDRAGSKDMRKLKIVKLFCDVTDLYDQLYVIKDLSSSMK

SEQ ID NO: 163 - DNA, 1503 bp, Stevia rebaudiana
atggaggcttcatatctatacatttccattcttctgcttctagcttcgtacctcttcaccacccaacttcgtcgtaaatccgccaatctaccgccgacggtgttcccatccatccccataatcggtcatctctacctcctcaaaaaaccactctatagaacactagccaaaattgccgccaaatacggccctatcctccaactccaactagggtaccgccgtgtcctcgtaatctcctccccttccgccgccgaagaatgcttcaccaacaacgacgttatcttcgccaaccgtccgaagacgctattcggaaaaattgtagggggtaccagcctcgggtcgctgtcgtacggcgaccagtggcgcaacctccgccgcgttgcatccatcgagattctatcagtccaccggctcaacgagtttcacgacatacgtgttgacgaaaaccggcttctgatccgtaaactaagatccagttcttctccggtgactctgataacggtgttttacgcactaacgttaaatgtgattatgagaatgatctccggaaagaggtatttcgactcgggtgatcgggaattggaggaggaagggaagcgattccgggagatactcgatgagacacttttgctcgcgggtgcttctaatgttggggattacttgccgattctgaattggttgggggtgaagagcttggagaagaagctaatcgcattgcagaaaaagagagatgatttctttcagggactgatcgagcaagttcggaaatctagaggggctaaagtgggaaaaggaaggaagacgatgatcgagttgttgttatccctacaagaatctgaacctgagtattacactgacgccatgatccgatcatttgtgctgggtttattagcagcagggagtgatacatcggctggaactatggaatgggcgatgtctcttttggtaaaccacccgcacgtattaaaaaaggcacaggctgaaattgatcgagtcatcggcaacaaccgtctaattgatgagtccgacatagggaatataccttacattggttgcatcataaacgagacgctcagattgtaccctgcgggcccgttgctatttccccatgagtcatcagcggactgtgttatcagcgggtacaacatccctcgtgggacgatgcttattgtcaaccaatgggcgatacatcatgacccaaaggtgtgggacgaccctgagacattcaaaccggaaagattccaagggcttgaagggacacgagacgggtttaagctgatgccttttgggtccggaaggaggggttgtccaggggagggattggcgattcgtttgcttgggatgactctcgggtcggttatccaatgctttgattgggaacgagtcggtgacgagatggttgatatgaccgaaggtcttggggtcacgttgcctaaagctgtaccattagtcgccaagtgcaagccgcgttccgaaatgacgaatctactctctgagctatga

SEQ ID NO: 164 - protein, 500 aa, Stevia rebaudiana
MEASYLYISILLLLASYLFTTQLRRKSANLPPTVFPSIPIIGHLYLLKKPLYRTLAKIAAKYGPILQLQLGYRRVLVISSPSAAEECFTNNDVIFANRPKTLFGKIVGGTSLGSLSYGDQWRNLRRVASIEILSVHRLNEFHDIRVDENRLLIRKLRSSSSPVTLITVFYALTLNVIMRMISGKRYFDSGDRELEEEGKRFREILDETLLLAGASNVGDYLPILNWLGVKSLEKKLIALQKKRDDFFQGLIEQVRKSRGAKVGKGRKTMIELLLSLQESEPEYYTDAMIRSFVLGLLAAGSDTSAGTMEWAMSLLVNHPHVLKKAQAEIDRVIGNNRLIDESDIGNIPYIGCIINETLRLYPAGPLLFPHESSADCVISGYNIPRGTMLIVNQWAIHHDPKVWDDPETFKPERFQGLEGTRDGFKLMPFGSGRRGCPGEGLAIRLLGMTLGSVIQCFDWERVGDEMVDMTEGLGVTLPKAVPLVAKCKPRSEMTNLLSEL

SEQ ID NO: 165 - DNA, 1503 bp, Stevia rebaudiana
atggaagcctcttacctatacatttctattttgcttttactggcatcatacctgttcaccactcaacttagaaggaagagcgctaatctaccaccaaccgtgtttccatcaataccaatcattggacacttatacttactcaaaaagcctctttatagaactttagcaaaaattgccgctaagtacggaccaatactgcaattacaactcggctacagacgtgttctggtgatttcctcaccatcagcagcagaagagtgctttaccaataacgatgtaatcttcgcaaatagacctaagacattgtttggcaaaatagtgggtggaacatcccttggcagtttatcctacggcgatcaatggcgtaatctaaggagagtagcttctatcgaaatcctatcagttcataggttgaacgaatttcatgatatcagagtggatgagaacagattgttaattagaaaacttagaagttcatcttctcctgttactcttataacagtcttttatgctctaacattgaacgtcattatgagaatgatctctggcaaaagatatttcgacagtggggatagagaattggaggaggaaggtaagagatttcgagaaatcttagacgaaacgttgcttctagccggtgcttctaatgttggcgactacttaccaatattgaactggttgggagttaagtctcttgaaaagaaattgatcgctttgcagaaaaagagagatgactttttccagggtttgattgaacaggttagaaaatctcgtggtgctaaagtaggcaaaggtagaaaaacgatgatcgaactcttattatctttgcaagagtcagaacctgagtactatacagatgctatgataagatcttttgtcctaggtctgctggctgcaggtagtgatacttcagcgggcactatggaatgggccatgagcttactggtcaatcacccacatgtattgaagaaagctcaagctgaaatcgatagagttatcggtaataacagattgattgacgagtcagacattggaaatatcccttacatcgggtgtattatcaatgaaactctaagactctatccagcagggccattgttgttcccacatgaaagttctgccgactgcgttatttccggttacaatatacctagaggtacaatgttaatcgtaaaccaatgggcgattcatcacgatcctaaagtctgggatgatcctgaaacctttaaacctgaaagatttcaaggattagaaggaactagagatggtttcaaacttatgccattcggttctgggagaagaggatgtccaggtgaaggtttggcaataaggctgttagggatgacactaggctcagtgatccaatgttttgattgggagagagtaggagatgagatggttgacatgacagaaggtttgggtgtcacacttcctaaggccgttccattagttgccaaatgtaagccacgttccgaaatgactaatctcctatccgaactttaa

SEQ ID NO: 166 - protein, 691 aa, Saccharomyces cerevisiae
MPFGIDNTDFTVLAGLVLAVLLYVKRNSIKELLMSDDGDITAVSSGNRDIAQVVTENNKNYLVLYASQTGTAEDYAKKFSKELVAKFNLNVMCADVENYDFESLNDVPVIVSIFISTYGEGDFPDGAVNFEDFICNAEAGALSNLRYNMFGLGNSTYEFFNGAAKKAEKHLSAAGAIRLGKLGEADDGAGTTDEDYMAWKDSILEVLKDELHLDEQEAKFTSQFQYTVLNEITDSMSLGEPSAHYLPSHQLNRNADGIQLGPFDLSQPYIAPIVKSRELFSSNDRNCIHSEFDLSGSNIKYSTGDHLAVWPSNPLEKVEQFLSIFNLDPETIFDLKPLDPTVKVPFPTPTTIGAAIKHYLEITGPVSRQLFSSLIQFAPNADVKEKLTLLSKDKDQFAVEITSKYFNIADALKYLSDGAKWDTVPMQFLVESVPQMTPRYYSISSSSLSEKQTVHVTSIVENFPNPELPDAPPVVGVTTNLLRNIQLAQNNVNIAETNLPVHYDLNGPRKLFANYKLPVHVRRSNFRLPSNPSTPVIMIGPGTGVAPFRGFIRERVAFLESQKKGGNNVSLGKHILFYGSRNTDDFLYQDEWPEYAKKLDGSFEMVVAHSRLPNTKKVYVQDKLKDYEDQVFEMINNGAFIYVCGDAKGMAKGVSTALVGILSRGKSITTDEATELIKMLKTSGRYQEDVW

SEQ ID NO: 167 - protein, 335 aa, Saccharomyces cerevisiae [sequence omitted]

SEQ ID NO: 168 - protein, 712 aa, Arabidopsis thaliana
MSSSSSSSTSMIDLMAAIIKGEPVIVSDPANASAYESVAAELSSMLIENRQFAMIVTTSIAVLIGCIVMLVWRRSGSGNSKRVEPLKPLVIKPREEEIDDGRKKVTIFFGTQTGTAEGFAKALGEEAKARYEKTRFKIVDLDDYAADDDEYEEKLKKEDVAFFFLATYGDGEPTDNAARFYKWFTEGNDRGEWLKNLKYGVFGLGNRQYEHFNKVAKVVDDILVEQGAQRLVQVGLGDDDQCIEDDFTAWREALWPELDTILREEGDTAVATPYTAAVLEYRVSIHDSEDAKFNDITLANGNGYTVFDAQHPYKANVAVKRELHTPESDRSCIHLEFDIAGSGLTMKLGDHVGVLCDNLSETVDEALRLLDMSPDTYFSLHAEKEDGTPISSSLPPPFPPCNLRTALTRYACLLSSPKKSALVALAAHASDPTEAERLKHLASPAGKDEYSKWVVESQRSLLEVMAEFPSAKPPLGVFFAGVAPRLQPRFYSISSSPKIAETRIHVTCALVYEKMPTGRIHKGVCSTWMKNAVPYEKSEKLFLGRPIFVRQSNFKLPSDSKVPIIMIGPGTGLAPFRGFLQERLALVESGVELGPSVLFFGCRNRRMDFIYEEELQRFVESGALAELSVAFSREGPTKEYVQHKMMDKASDIWNMISQGAYLYVCGDAKGMARDVHRSLHTIAQEQGSMDSTKAEGFVKNLQTSGRYLRDVW

SEQ ID NO: 169 - protein, 709 aa, Stevia rebaudiana
MQSESVEASTIDLMTAVLKDTVIDTANASDNGDSKMPPALAMMFEIRDLLLILTTSVAVLVGCFVVLVWKRSSGKKSGKELEPPKIVVPKRRLEQEVDDGKKKVTIFFGTQTGTAEGFAKALFEEAKARYEKAAFKVIDLDDYAADLDEYAEKLKKETYAFFFLATYGDGEPTDNAAKFYKWFTEGDEKGVWLQKLQYGVFGLGNRQYEHFNKIGIVVDDGLTEQGAKRIVPVGLGDDDQSIEDDFSAWKELVWPELDLLLRDEDDKAAATPYTAAIPEYRVVFHDKPDAFSDDHTQTNGHAVHDAQHPCRSNVAVKKELHTPESDRSCTHLEFDISHTGLSYETGDHVGVYCENLIEVVEEAGKLLGLSTDTYFSLHIDNEDGSPLGGPSLQPPFPPCTLRKALTNYADLLSSPKKSTLLALAAHASDPTEADRLRFLASREGKDEYAEWVVANQRSLLEVMEAFPSARPPLGVFFAAVAPRLQPRYYSISSSPKMEPNRIHVTCALVYEKTPAGRIHKGICSTWMKNAVPLTESQDCSWAPIFVRTSNFRLPIDPKVPVIMIGPGTGLAPFRGFLQERLALKESGTELGSSILFFGCRNRKVDYIYENELNNFVENGALSELDVAFSRDGPTKEYVQHKMTQKASEIWNMLSEGAYLYVCGDAKGMAKDVHRTLHTIVQEQGSLDSSKAELYVKNLQMSGRYLRDVW

SEQ ID NO: 170 - protein, 707 aa, Stevia rebaudiana
MQSNSVKISPLDLVTALFSGKVLDTSNASESGESAMLPTIAMIMENRELLMILTTSVAVLIGCVVVLVWRRSSTKKSALEPPVIVVPKRVQEEEVDDGKKKVTVFFGTQTGTAEGFAKALVEEAKARYEKAVFKVIDLDDYAADDDEYEEKLKKESLAFFFLATYGDGEPTDNAARFYKWFTEGDAKGEWLNKLQYGVFGLGNRQYEHFNKIAKVVDDGLVEQGAKRLVPVGLGDDDQCIEDDFTAWKELVWPELDQLLRDEDDTTVATPYTAAVAEYRVVFHEKPDALSEDYSYTNGHAVHDAQHPCRSNVAVKKELHSPESDRSCTHLEFDISNTGLSYETGDHVGVYCENLSEVVNDAERLVGLPPDTYSSIHTDSEDGSPLGGASLPPPFPPCTLRKALTCYADVLSSPKKSALLALAAHATDPSEADRLKFLASPAGKDEYSQWIVASQRSLLEVMEAFPSAKPSLGVFFASVAPRLQPRYYSISSSPKMAPDRIHVTCALVYEKTPAGRIHKGVCSTWMKNAVPMTESQDCSWAPIYVRTSNFRLPSDPKVPVIMIGPGTGLAPFRGFLQERLALKEAGTDLGLSILFFGCRNRKVDFIYENELNNFVETGALSELIVAFSREGPTKEYVQHKMSEKASDIWNLLSEGAYLYVCGDAKGMAKDVHRTLHTIVQEQGSLDSSKAELYVKNLQMSGRYLRDVW

SEQ ID NO: 171 - DNA, 2079 bp, Artificial Sequence; identical to SEQ ID NO: 71
  Arabidopsis thaliana sequence that has been codon optimized for yeast

SEQ ID NO: 172 - DNA, 2139 bp, Artificial Sequence
  Arabidopsis thaliana sequence that has been codon optimized for yeast
atgtcttcctcttcctcttccagtacctctatgattgatttgatggctgctattattaaaggtgaaccagttatcgtctccgacccagcaaatgcctctgcttatgaatcagttgctgcagaattgtcttcaatgttgatcgaaaacagacaattcgccatgatcgtaactacatcaatcgctgttttgatcggttgtattgtcatgttggtatggagaagatccggtagtggtaattctaaaagagtcgaacctttgaaaccattagtaattaagccaagagaagaagaaatagatgacggtagaaagaaagttacaatatttttcggtacccaaactggtacagctgaaggttttgcaaaagccttaggtgaagaagctaaggcaagatacgaaaagactagattcaagatagtcgatttggatgactatgccgctgatgacgatgaatacgaagaaaagttgaagaaagaagatgttgcatttttctttttggcaacctatggtgacggtgaaccaactgacaatgcagccagattctacaaatggtttacagagggtaatgatcgtggtgaatggttgaaaaacttaaagtacggtgttttcggtttgggtaacagacaatacgaacatttcaacaaagttgcaaaggttgtcgacgatattttggtcgaacaaggtgctcaaagattagtccaagtaggtttgggtgacgatgaccaatgtatagaagatgactttactgcctggagagaagctttgtggcctgaattagacacaatcttgagagaagaaggtgacaccgccgttgctaccccatatactgctgcagtattagaatacagagtttccatccatgatagtgaagacgcaaagtttaatgatatcactttggccaatggtaacggttatacagttttcgatgcacaacacccttacaaagctaacgttgcagtcaagagagaattacatacaccagaatccgacagaagttgtatacacttggaatttgatatcgctggttccggtttaaccatgaagttgggtgaccatgtaggtgttttatgcgacaatttgtctgaaactgttgatgaagcattgagattgttggatatgtcccctgacacttattttagtttgcacgctgaaaaagaagatggtacaccaatttccagttctttaccacctccattccctccatgtaacttaagaacagccttgaccagatacgcttgcttgttatcatcccctaaaaagtccgccttggttgctttagccgctcatgctagtgatcctactgaagcagaaagattgaaacacttagcatctccagccggtaaagatgaatattcaaagtgggtagttgaatctcaaagatcattgttagaagttatggcagaatttccatctgccaagcctccattaggtgtcttctttgctggtgtagcacctagattgcaaccaagattctactcaatcagttcttcacctaagatcgctgaaactagaattcatgttacatgtgcattagtctacgaaaagatgccaaccggtagaattcacaagggtgtatgctctacttggatgaaaaatgctgttccttacgaaaaatcagaaaagttgttcttaggtagaccaatcttcgtaagacaatcaaacttcaagttgccttctgattcaaaggttccaataatcatgataggtcctggtacaggtttagccccattcagaggtttcttgcaagaaagattggctttagttgaatctggtgtcgaattaggtccttcagttttgttctttggttgtagaaacagaagaatggatttcatctatgaagaagaattgcaaagattcgtcgaatctggtgcattggccgaattatctgtagctttttcaagagaaggtccaactaaggaatacgttcaacataagatgatggataaggcatccgacatatggaacatgatcagtcaaggtgcttatttgtacgtttgcggtgacgcaaagggtatggccagagatgtccatagatctttgcacacaattgctcaagaacaaggttccatggatagtaccaaagctgaaggtttcgtaaagaacttacaaacttccggtagatacttgagagatgtctggtga

SEQ ID NO: 173 - DNA, 2130 bp, Stevia rebaudiana
atgcaatcggaatccgttgaagcatcgacgattgatttgatgactgctgttttgaaggacacagtgatcgatacagcgaacgcatctgataacggagactcaaagatgccgccggcgttggcgatgatgttcgaaattcgtgatctgttgctgattttgactacgtcagttgctgttttggtcggatgtttcgttgttttggtgtggaagagatcgtccgggaagaagtccggcaaggaattggagccgccgaagatcgttgtgccgaagaggcggctggagcaggaggttgatgatggtaagaagaaggttacgattttcttcggaacacaaactggaacggctgaaggtttcgctaaggcacttttcgaagaagcgaaagcgcgatatgaaaaggcagcgtttaaagtgattgatttggatgattatgctgctgatttggatgagtatgcagagaagctgaagaaggaaacatatgctttcttcttcttggctacatatggagatggtgagccaactgataatgctgccaaattttataaatggtttactgagggagacgagaaaggcgtttggcttcaaaaacttcaatatggagtatttggtcttggcaacagacaatatgaacatttcaacaagattggaatagtggttgatgatggtctcaccgagcagggtgcaaaacgcattgttcccgttggtcttggagacgacgatcaatcaattgaagacgatttttcggcatggaaagagttagtgtggcccgaattggatctattgcttcgcgatgaagatgacaaagctgctgcaactccttacacagctgcaatccctgaataccgcgtcgtatttcatgacaaacccgatgcgttttctgatgatcatactcaaaccaatggtcatgctgttcatgatgctcaacatccatgcagatccaatgtggctgttaaaaaagagcttcatactcctgaatccgatcgttcatgcacacatcttgaatttgacatttctcacactggattatcttatgaaactggggatcatgttggtgtatactgtgaaaacctaattgaagtagtggaagaagctgggaaattgttaggattatcaacagatacttatttctcgttacatattgataacgaagatggttcaccacttggtggaccttcattacaacctccttttcctccttgtactttaagaaaagcattgactaattatgcagatctgttaagctctcccaaaaagtcaactttgcttgctctagctgctcatgcttccgatcccactgaagctgatcgtttaagatttcttgcatctcgcgagggcaaggatgaatatgctgaatgggttgttgcaaaccaaagaagtcttcttgaagtcatggaagctttcccgtcagctagaccgccacttggtgttttctttgcagcggttgcaccgcgtttacagcctcgttactactctatttcttcctccccaaagatggaaccaaacaggattcatgttacttgcgcgttggtttatgaaaaaactcccgcaggtcgtatccacaaaggaatctgctcaacctggatgaagaacgctgtacctttgaccgaaagtcaagattgcagttgggcaccgatttttgttagaacatcaaacttcagacttccaattgacccgaaagtcccggttatcatgattggtcctggaaccgggttggctccatttaggggttttcttcaagaaagattggctcttaaagaatccggaaccgaactcgggtcatctattttattcttcggttgtagaaaccgcaaagtggattacatatatgagaatgaactcaacaactttgttgaaaatggtgcgctttctgagcttgatgttgctttctcccgcgatggcccgacgaaagaatacgtgcaacataaaatgacccaaaaggcttctgaaatatggaatatgctttctgagggagcatatttatatgtatgtggtgatgctaaaggcatggctaaagatgtacaccgtacacttcacaccattgtgcaagaacagggaagtttggactcgtctaaagcggagttgtatgtgaagaatctacaaatgtcaggaagatacctccgtgatgtttggtaa

SEQ ID NO: 174 - DNA, 2124 bp, Stevia rebaudiana
atgcaatctaactccgtgaagatttcgccgcttgatctggtaactgcgctgtttagcggcaaggttttggacacatcgaacgcatcggaatcgggagaatctgctatgctgccgactatagcgatgattatggagaatcgtgagctgttgatgatactcacaacgtcggttgctgtattgatcggatgcgttgtcgttttggtgtggcggagatcgtctacgaagaagtcggcgttggagccaccggtgattgtggttccgaagagagtgcaagaggaggaagttgatgatggtaagaagaaagttacggttttcttcggcacccaaactggaacagctgaaggcttcgctaaggcacttgttgaggaagctaaagctcgatatgaaaaggctgtctttaaagtaattgatttggatgattatgctgctgatgacgatgagtatgaggagaaactaaagaaagaatctttggcctttttctttttggctacgtatggagatggtgagccaacagataatgctgccagattttataaatggtttactgagggagatgcgaaaggagaatggcttaataagcttcaatatggagtatttggtttgggtaacagacaatatgaacattttaacaagatcgcaaaagtggttgatgatggtcttgtagaacagggtgcaaagcgtcttgttcctgttggacttggagatgatgatcaatgtattgaagatgacttcaccgcatggaaagagttagtatggccggagttggatcaattacttcgtgatgaggatgacacaactgttgctactccatacacagctgctgttgcagaatatcgcgttgtttttcatgaaaaaccagacgcgctttctgaagattatagttatacaaatggccatgctgttcatgatgctcaacatccatgcagatccaacgtggctgtcaaaaaggaacttcatagtcctgaatctgaccggtcttgcactcatcttgaatttgacatctcgaacaccggactatcatatgaaactggggaccatgttggagtttactgtgaaaacttgagtgaagttgtgaatgatgctgaaagattagtaggattaccaccagacacttactcctccatccacactgatagtgaagacgggtcgccacttggcggagcctcattgccgcctcctttcccgccatgcactttaaggaaagcattgacgtgttatgctgatgttttgagttctcccaagaagtcggctttgcttgcactagctgctcatgccaccgatcccagtgaagctgatagattgaaatttcttgcatcccccgccggaaaggatgaatattctcaatggatagttgcaagccaaagaagtctccttgaagtcatggaagcattcccgtcagctaagccttcacttggtgttttctttgcatctgttgccccgcgcttacaaccaagatactactctatttcttcctcacccaagatggcaccggataggattcatgttacatgtgcattagtctatgagaaaacacctgcaggccgcatccacaaaggagtttgttcaacttggatgaagaacgcagtgcctatgaccgagagtcaagattgcagttgggccccaatatacgtccgaacatccaatttcagactaccatctgaccctaaggtcccggttatcatgattggacctggcactggtttggctccttttagaggtttccttcaagagcggttagctttaaaggaagccggaactgacctcggtttatccattttattcttcggatgtaggaatcgcaaagtggatttcatatatgaaaacgagcttaacaactttgtggagactggtgctctttctgagcttattgttgctttctcccgtgaaggcccgactaaggaatatgtgcaacacaagatgagtgagaaggcttcggatatctggaacttgctttctgaaggagcatatttatacgtatgtggtgatgccaaaggcatggccaaagatgtacatcgaaccctccacacaattgtgcaagaacagggatctcttgactcgtcaaaggcagaactctacgtgaagaatctacaaatgtcaggaagatacctccgtgacgtttggtaa

SEQ ID NO: 175 - DNA, 2427 bp, Arabidopsis thaliana
atggcaaacgctgaacgtatgataacgcgcgtccacagccaacgtgagcgtttgaacgaaacgcttgtttctgagagaaacgaagtccttgccttgctttccagggttgaagccaaaggtaaaggtattttacaacaaaaccagatcattgctgaattcgaagctttgcctgaacaaacccggaagaaacttgaaggtggtcctttctttgaccttctcaaatccactcaggaagcaattgtgttgccaccatgggttgctctagctgtgaggccaaggcctggtgtttgggaatacttacgagtcaatctccatgctcttgtcgttgaagaactccaacctgctgagtttcttcatttcaaggaagaactcgttgatggagttaagaatggtaatttcactcttgagcttgatttcgagccattcaatgcgtctatccctcgtccaacactccacaaatacattggaaatggtgttgacttccttaaccgtcatttatcggctaagctcttccatgacaaggagagtttgcttccattgcttaagttccttcgtcttcacagccaccagggcaagaacctgatgttgagcgagaagattcagaacctcaacactctgcaacacaccttgaggaaagcagaagagtatctagcagagcttaagtccgaaacactgtatgaagagtttgaggccaagtttgaggagattggtcttgagaggggatggggagacaatgcagagcgtgtccttgacatgatacgtcttcttttggaccttcttgaggcgcctgatccttgcactcttgagacttttcttggaagagtaccaatggtgttcaacgttgtgatcctctctccacatggttactttgctcaggacaatgttcttggttaccctgacactggtggacaggttgtttacattcttgatcaagttcgtgctctggagatagagatgcttcaacgtattaagcaacaaggactcaacattaaaccaaggattctcattctaactcgacttctacctgatgcggtaggaactacatgcggtgaacgtctcgagagagtttatgattctgagtactgtgatattcttcgtgtgcccttcagaacagagaagggtattgttcgcaaatggatctcaaggttcgaagtctggccatatctagagacttacaccgaggatgctgcggttgagctatcgaaagaattgaatggcaagcctgaccttatcattggtaactacagtgatggaaatcttgttgcttctttattggctcacaaacttggtgtcactcagtgtaccattgctcatgctcttgagaaaacaaagtacccggattctgatatctactggaagaagcttgacgacaagtaccatttctcatgccagttcactgcggatattttcgcaatgaaccacactgatttcatcatcactagtactttccaagaaattgctggaagcaaagaaactgttgggcagtatgaaagccacacagcctttactcttcccggattgtatcgagttgttcacgggattgatgtgtttgatcccaagttcaacattgtctctcctggtgctgatatgagcatctacttcccttacacagaggagaagcgtagattgactaagttccactctgagatcgaggagctcctctacagcgatgttgagaacaaagagcacttatgtgtgctcaaggacaagaagaagccgattctcttcacaatggctaggcttgatcgtgtcaagaacttgtcaggtcttgttgagtggtacgggaagaacacccgcttgcgtgagctagctaacttggttgttgttggaggagacaggaggaaagagtcaaaggacaatgaagagaaagcagagatgaagaaaatgtatgatctcattgaggaatacaagctaaacggtcagttcaggtggatctcctctcagatggaccgggtaaggaacggtgagctgtaccggtacatctgtgacaccaagggtgcttttgtccaacctgcattatatgaagcctttgggttaactgttgtggaggctatgacttgtggtttaccgactttcgccacttgcaaaggtggtccagctgagatcattgtgcacggtaaatcgggtttccacattgacccttaccatggtgatcaggctgctgatactcttgctgatttcttcaccaagtgtaaggaggatccatctcactgggatgagatctcaaaaggagggcttcagaggattgaggagaaatacacttggcaaatctattcacagaggctcttgacattgactggtgtgtatggattctggaagcatgtctcgaaccttgaccgtcttgaggctcgccgttaccttgaaatgttctatgcattgaagtatcgcccattggctcaggctgttcctcttgcacaagatgattga

SEQ ID NO: 176 - DNA, 2421 bp, Stevia rebaudiana
atggcggaacgtgtactcactcgtgttcacgaacttcgtgagcgtctcgattcaactctcgcaactcatcgtaatgaaatcctcttgtttctttcaaggattgaaagccatggaaaaggaatattgaagcctcatcaagttatgactgaatttgaagctatctgcaaagaagatcagagcaaactctctgatggtgctttttatgaagttcttaaatgcacacaggaagcaatagtgcaacctccatgggttgcactcgcgatccgtcttcgacccggtgtttgggaatatgttagagtcaatgttaatgttttggtggttgaagaattaagtgttcctgaatatcttcacttcaaagaagaattggttaatggaacatcgaatggcaacttcgtgttggaactggattttgaaccttttaccgcatcgtttcctcgaccaactttaaccaagtctattggtaatggtgttgagtttctaaacagacatttatctgctaaaatgtttcatgataaggatagcatgcaccctcttcttgatttcctacggactcaccactataagggaaagacaatgatgttgaatgatagaatccaaaacctcaatgctctacaatcggtgttgcgaaaggcgtcagagtacttatcaacactcgacgcggcaacaccgtactctcagtttgaacataagtttcaagaaatcgggttggagagaggttggggtgataaagcggaggtcgtaatggagatgatccacatgcttctagaccttctagaagcacccgacgcatgcacactcgagaagtttctcggaagaatcccaatggttttcaatgttgtcattctttcgcctcatggctacttcgcgcaagaaaatgtgttgggatatcccgacactggcggtcaggttgtttacatcttggatcaagttcccgctctggaacgcgagatgctcaaaaggattaaggagcaaggactcgatatcattcctcgtatattgattgttacgaggcttcttcctgacgcggttgggaccacatgcgggcaacgtttagagaaagtgtttggagccgaacactcgcatattcttcgggtcccgtttagaaccgaaaagggtattcttcgtaaatggatctctcgttttgaggtgtggccttacatcgagactttcaccgaggatgttgctaaagaagttacagcagagttgcaagcaaaaccagatttgatcattggaaactatagtgaaggaaatttggttgcatctttgctagctcacaagttgggtgtcactcagtgtaccattgctcatgctttggagaaaactaaatacccggattctgatatctactggaagaactttgaggagaaatatcatttctcttcgcagtttaccgctgatcttatcgctatgaaccataccgacttcatcatcaccagtactttccaagaaattgctggaagtaaggacacggttggacagtacgagagtcataccgcgttcacaatgccgggattgtatcgggtggttcacgggatcgatgtttttgaccccaaattcaatattgtttcacccggggccgatatgggaatttactactcgtataccgagaaagaaaagaggctcactgcgcttcaccctgaaatcgatgaacttctctttagttccgtcgaaaacgaagaacacttatgtgtgttgaaggataagagtaaaccaatcttgttcacaatggcgcgattggataatgtgaagaatttaaccggactggttgaatggtacgctaaaaacgaccgccttcgtgagctcgtgaacctcgtggtcgtcggtggtgaccgaaggaaagagtcgaaagatcttgaagagcaagctcagatgaagaagatgcatgaacttatcgaaacctacaaactcaacggtcagttcaggtggatatcctcacaaatgaaccgcgtgaggaacggtgagttgtatcgcgttattgctgacacgcgaggtgcgtttatccagcctgcgttttacgaggcgtttgggttgacggttgtggaggccatgacttgtggcctgccgacattcgcgacacttcatggtgggcccgctgagattattgttcacgggaaatccgggttccatattgacccgtatcacggtgaccaggtcaccgagttgctggtcaatttctttgagaaaactaaacaagacccgggtcattgggaggccatttccaagggtggtctgcaacgtattcaggagaaatacacgtggcagatttattcagataggttgttgacgcttgccggagtttatggattctggaagcatgtgtcgaagcttgacaggctcgagatccgtcgttatcttgaaatgttttacgcgctcaagtatcgcaaactggctgaatctgttccattggctgttgatgagtga

SEQ ID NO: 177 - DNA, 2421 bp, Coffea arabica
atggccgaacgtgttctgacccgtgttcacagcctccgcgaacgccttgatgctactttggctgcccaccgcaacgatgttttgctgtttatgtcgaggcttgaaacccatgggaaagggatcctgaaaccccaccaacttttggctgagtttgaagaaattaacaaggatggtaaacaaaaaattcatgatcatgcctttgaagaagtcctgaagtccacacaggaagcaattgtgttgcccccctgggttgcacttgctattcgtctcagacctggtgtctgggagtatgttcgagtcaatgtccatgcactcgttgttgaggagttaaccgtgccagagtacctgcatttcaaggaagaactcgttgatggaagcaaaaatgggaattttgttttggaactggacttcgaaccatttacagcctcttttcccaagccaactctaactaagtacataggcgacggagttgagttcctcaacaggcacctctctgccaaaatgttccatgacaaggagagcatggcccctctccttgattttctccgtgttcaccaatacaagggcaagacaatgatgcttaacgacaggatcaaggaccttaacactctccaagcagttctgaggaaggcagaggagtacctaacaacactctctgcagatacaccatactctgaattcgagcacaaattccaagaaattggactggagagaggttggggtgatactgctgagcgtgtcttggaaatgatctgcatgcttctggatcttctgggggctcctgactcgtgcacactagagaaattcctagggagaatccctatggtattcaatgttgttattctttccccccatggatactttgcccaggaaaacgtattgggttatcctgataccggtggccaggttgtttacatattggatcaagttcctgccttggagcgtgagatgctgaagaggataaaggaacaaggacttgatgtcaagccacgcattctaattataactaggctgcttcctgatgcccctggaaccacttgtggtcaacggcttgagaaagtatatggatcagagtactcccatatactcagagtccccttcagaactgagaagggagttgttcgcaaatggatctctcgctttgaagtttggccctacatggaaacatttactgaggatgttgcaaaagaagtcactgcagaattacaggcaaagccagatttggttattggtaactacagtgagggtaaccttgttgcctccttgcttgctcacaagttaggtgtaacacagtgtaccattgctcatgctttggaaaaaaccaagtatcctgattctgatatttatttgagcaaatttgatgaaaagtaccacttctcatgtcagttcactgcggatcttatcgcaatgaaccatacagatttcattatcactagcactttccaagaaatagctggaagcaaggacactgttgggcaatatgaaagccatatggccttcacaatgccaggattatacagagttgtacatggcattgatgtttttgatccaaaattcaacattgtctcacctggagctgatacaaacctctacttcccacacacagagaaggaaaagagattgacatctttccatcctgaaattgaggagttgcttttcagcgatgtggagaatgaggaacacctatgtgtgctaaaagacaaaaagaagcctatcttattcaccatggcaagactggatcgcgtaaagaatttgacagggcttgttgaattgtatgctaagaacccaaaactaagggaattggtcaatcttgtcgtggttggtggagaccgaaggaaggaatccaaagatttggaagaacaagctgagatgaagaaaatgtattcattgatagaaacttacaacttgaacggccaattcagatggatttcttctcagatgaacagggttagaaatggtgaactctatcggtacattgctgacaccaggggagcattcgtgcaacctgcattttatgaggcatttgggttgactgtggtcgaggccatgacatgtggtttgccaacatttgcaaccaaccatggtggtcctgctgagatcattattcatgggaaatctggtttccacattgatccataccatggtgagcaggtcagcgagctccttgccaatttctttgaaaggtgcaagaaagagccttcttactgggacaccatttcagccggtggcttgaagcgtatccaggaaaagtacacctggcaaatttactcagatcggttgctgacgctggctggagtttatggattctggaaatgtgtttccaagcttgatcgccaggagatccgccgttatctggaaatgttttatgctctcaagtatcgcaagttggctgaagctgttccattggctgttgatcagtaa

SEQ ID NO: 178 - protein, 481 aa, Arabidopsis thaliana
MHITKPHAAMFSSPGMGHVIPVIELGKRLSANNGFHVTVFVLETDAASAQSKFLNSTGVDIVKLPSPDIYGLVDPDDHVVTKIGVIMRAAVPALRSKIAAMHQKPTALIVDLFGTDALCLAKEFNMLSYVFIPTNARFLGVSIYYPNLDKDIKEEHTVQRNPLAIPGCEPVRFEDTLDAYLVPDEPVYRDFVRHGLAYPKADGILVNTWEEMEPKSLKSLLNPKLLGRVARVPVYPIGPLCRPIQSSETDHPVLDWLNEQPNESVLYISFGSGGCLSAKQLTELAWGLEQSQQRFVWVVRPPVDGSCCSEYVSANGGGTEDNTPEYLPEGFVSRTSDRGFVVPSWAPQAEILSHRAVGGFLTHCGWSSTLESVVGGVPMIAWPLFAEQNMNAALLSDELGIAVRLDDPKEDISRWKIEALVRKVMTEKEGEAMRRKVKKLRDSAEMSLSIDGGGLAHESLCRVTKECQRFLERVVDLSRGA

SEQ ID NO: 179 - protein, 513 aa, Arabidopsis thaliana
MGAYETEKPTKDAAALETQSPEDFDQPSPLRKIISVASIAAGVQFGWALQLSLLTPYVQLLGIPHKWSSLIWLCGPVSGMIVQPIVGFHSDRCRSKFGRRRPFIATGAALVAVAVFLIGYAADFGYKMGDKLEEKVKVRAIGIFALGFWILDVANNTLQGPCRAFLADLAAGDAKRTRVANAFFSFFMAVGNVLGYAAGSYTNLHKMFPFTMTKACDIYCANLKTCFFLSITLLLIVTVTSLWYVNDKQWSPPPRNADDDEKTSSVPLFGEIFGAFKVMKRPMWMLLIVTALNWIAWFPFLLFDTDWMGREVFGGDSDGNERSKKLYSLGVQSGAMGLMFNSIVLGFMSLGVEWIGRKLGGAKRLWGIVNFILAAGLAMTVLVTKFAEDHRKTAGDLAGPSASVKAGALSLFAVLGIPLAITFSTPFALASIFSSCSGAGQGLSLGVLNLAIVIPQMIVSLGGGPFDALFGGGNLPAFIVAAIAAAISGVLALTVLPSPPPDAPKATTMGGFH

SEQ ID NO: 180 - protein, 806 aa, Coffea arabica
MAERVLTRVHSLRERLDATLAAHRNDVLLFMSRLETHGKGILKPHQLLAEFEEINKDGKQKIHDHAFEEVLKSTQEAIVLPPWVALAIRLRPGVWEYVRVNVHALVVEELTVPEYLHFKEELVDGSKNGNFVLELDFEPFTASFPKPTLTKYIGDGVEFLNRHLSAKMFHDKESMAPLLDFLRVHQYKGKTMMLNDRIKDLNTLQAVLRKAEEYLTTLSADTPYSEFEHKFQEIGLERGWGDTAERVLEMICMLLDLLGAPDSCTLEKFLGRIPMVFNVVILSPHGYFAQENVLGYPDTGGQVVYILDQVPALEREMLKRIKEQGLDVKPRILIITRLLPDAPGTTCGQRLEKVYGSEYSHILRVPFRTEKGVVRKWISRFEVWPYMETFTEDVAKEVTAELQAKPDLVIGNYSEGNLVASLLAHKLGVTQCTIAHALEKTKYPDSDIYLSKFDEKYHFSCQFTADLIAMNHTDFIITSTFQEIAGSKDTVGQYESHMAFTMPGLYRVVHGIDVFDPKFNIVSPGADTNLYFPHTEKEKRLTSFHPEIEELLFSDVENEEHLCVLKDKKKPILFTMARLDRVKNLTGLVELYAKNPKLRELVNLVVVGGDRRKESKDLEEQAEMKKMYSLIETYNLNGQFRWISSQMNRVRNGELYRYIADTRGAFVQPAFYEAFGLTVVEAMTCGLPTFATNHGGPAEIIIHGKSGFHIDPYHGEQVSELLANFFERCKKEPSYWDTISAGGLKRIQEKYTWQIYSDRLLTLAGVYGFWKCVSKLDRQEIRRYLEMFYALKYRKLAEAVPLAVDQ

SEQ ID NO: 181 - DNA, 19 bp, Artificial Sequence
  Hairpin loop forming sequence
tgaattcgttaacgaattc

SEQ ID NO: 182 - DNA, 19 bp, Artificial Sequence
  Hairpin loop forming sequence
tgaattcgttaacgaactc

SEQ ID NO: 183 - DNA, 19 bp, Artificial Sequence
  Hairpin loop forming sequence
tgaattcgttaacgaagtc

SEQ ID NO: 184 - DNA, 19 bp, Artificial Sequence
  Hairpin loop forming sequence
tgaattcgttaacgaaatt

SEQ ID NO: 185 - DNA, 287 bp, Saccharomyces cerevisiae
gcgttggttggtggatcaagcccacgcgtaggcaatcctcgagcagatccgccaggcgtgtatatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggacctttgcagcataaattactatacttctatagacacacaaacacaaatacacacactaaattaata

SEQ ID NO: 186 - DNA, 491 bp, Saccharomyces cerevisiae
ggtcagcagctctgatgtagatacacgtatctcgacatgttttatttttactatacatacataaaagaaataaaaaatgataacgtgtatattattattcatataatcaatgagggtcattttctgaaacgcaaaaaacggtaaatggaaaaaaaataaagatagaaaaagaaaacaaacaaaggaaaggttagcatattaaataactgagctgatacttcaacagcatcgctgaagagaacagtattgaaaccgaaacattttctaaaggcaaacaaggtactccatatttgctggacgtgttctttctctcgtttcatatgcataattctgtcataagcctgttctttttcctggcttaaacatcccgttttgtaaaagagaaatctattccacatatttcattcattcggctaccatactaaggataaactaatcccgttgttttttggcctcgtcacataattataaactactaacccattatcaga

SEQ ID NO: 187 - DNA, 28 bp, Artificial Sequence
  Hairpin loop forming sequence
cacaaatacacacactaaattaataatg

SEQ ID NO: 188 - DNA, 47 bp, Artificial Sequence
  Hairpin loop forming sequence
cacaaatacacacactaaattaatatgaattcgttaacgaattcatg

SEQ ID NO: 189 - DNA, 47 bp, Artificial Sequence
  Hairpin loop forming sequence
cacaaatacacacactaaattaatatgaattcgttaacgaactcatg

SEQ ID NO: 190 - DNA, 47 bp, Artificial Sequence
  Hairpin loop forming sequence
cacaaatacacacactaaattaatatgaattcgttaacgaagtcatg

SEQ ID NO: 191 - DNA, 47 bp, Artificial Sequence
  Hairpin loop forming sequence
cacaaatacacacactaaattaatatgaattcgttaacgaaattatg

SEQ ID NO: 192 - protein, 444 aa, Saccharomyces cerevisiae
MGKLLQLALHPVEMKAALKLKFCRTPLFSIYDQSTSPYLLHCFELLNLTSRSFAAVIRELHPELRNCVTLFYLILRALDTIEDDMSIEHDLKIDLLRHFHEKLLLTKWSFDGNAPDVKDRAVLTDFESILIEFHKLKPEYQEVIKEITEKMGNGMADYILDENYNLNGLQTVHDYDVYCHYVAGLVGDGLTRLIVIAKFANESLYSNEQLYESMGLFLQKTNIIRDYNEDLVDGRSFWPKEIWSQYAPQLKDFMKPENEQLGLDCINHLVLNALSHVIDVLTYLAGIHEQSTFQFCAIPQVMAIATLALVFNNREVLHGNVKIRKGTTCYLILKSRTLRGCVEIFDYYLRDIKSKLAVQDPNFLKLNIQISKIEQFMEEMYQDKLPPNVKPNETPIFLKVKERSRYDDELVPTQQEEEYKFNMVLSIILSVLLGFYYIYTLHRA

SEQ ID NO: 193 - protein, 460 aa, Schizosaccharomyces pombe
MSLANRIEEIRCLCQYKLWNDLPSYGEDENVPQNIRRCYQLLDMTSRSFAVVIKELPNGIREAVMIFYLVLRGLDTVEDDMTLPLDKKLPILRDFYKTIEVEGWTFNESGPNEKDRQLLVEFDVVIKEYLNLSEGYRNVISNITKEMGDGMAYYASLAEKNDGFSVETIEDFNKYCHYVAGLVGIGLSRLFAQSKLEDPDLAHSQAISNSLGLFLQKVNIIRDYREDFDDNRHFWPREIWSKYTSSFGDLCLPDNSEKALECLSDMTANALTHATDALVYLSQLKTQEIFNFCAIPQVMAIATLAAVFRNPDVFQTNVKIRKGQAVQIILHSVNLKNVCDLFLRYTRDIHYKNTPKDPNFLKISIECGKIEQVSESLFPRRFREMYEKAYVSKLSEQKKGNGTQKAILNDEQKELYRKDLQKLGISILFVFFIILVCLAVIFYVFNIRIHWSDFKELNLF

SEQ ID NO: 194 - protein, 445 aa, Yarrowia lipolytica
MGKLIELLLHPSELSAAIHYKLWRQPLHPRDLSKESTELRRCYELLDVCSRSFAAVIRELHPEVRDAVMLFYLILRALDTIEDDMTLSRDIKIPILRDFTKCMKTPGWKFTDSDPNERDRVVLQEFPVVMTEFNKLKPKYQEVIYDITDRMGNGMADYVIDDDFNNNGVDTIAAYDLYCHHVAGIVGEGLTRITILAGFGTDVLHENPRLQESMGLFLQKVNIIRDYREDIDVNRAFWPREIWHKYAEEMRDFKDPKYSKKALHCTSDLVANALGHATDCLDYLDNVTDPSTFTFCAIPQVMAIATLDLVYRNPDVFQKNVKLRKGTTVSLILEASNVSGVCDIFTRYARKVYKKSDPNDPNYFRVSVLCGKIEQHAALIKRQRGPPAKTIAQLEGERKEMALSLIVCLAVIFSMSGLMAYIAYVSGFRWSPREIFDSKMFPLRD

SEQ ID NO: 195 - protein, 443 aa, Candida glabrata
MGKVLDLALHPLELRAALKLKFIRQPLFSTNDTRATPQLERCYELLNLTSRSFAAVIMELHPELRNVIMVFYLILRALDTVEDDMTIDPQLKVKVLREFDSKLDTTDWSFDGNDLKEKDRVVLTEFPCILGEYHKLKPEYQKVIKRITGLMGNGMADYILDENFNLNGVQTVKDYDKYCHYVAGLVGDGLTELIVLAGFGSDDLYHGKNSFQLYESMGLFLQKTNIIRDYAEDLDDGRSFWPKEIWSEYATKLTDFRDPKNTQKGVDCINHLVLNALTHVIDVLTYLSSIHEQSSFQFCAIPQVMAIATLAKVFNNPEVLRKNVKIRKGTTCDLILNSRTLKGCVDIFQYYLRDMKQRLPVEDPNYLKFNIQVAKIEQFIEEMFQDNLPAGVEPRETMIYLKVQERLKWDTQVIPRVQEEDYKFNMALSVVFCVLLSFYFFTK

SEQ ID NO: 196 - protein, 441 aa, Ashbya gossypii
MGKVVQLFTHPLELKAALKLKFLREPLYPADDTQGSAELKRCYQLLQRTSRSFAAVIMELHPELRNAVMLFYLILRALDTVEDDMTISPKVKVPLLREFDQKLKLDTWSFDGNAKTEKDRDVLVEFSTILAEFHKLKPEYQQVIADITHKMGNGMADYILDEKFNLSGLETIQDYDRYCHYVAGLVGDGLTHLIMLAKFSSPGLYYDSPDLYESMGLFLQKTNIIRDYAEDLADGRSFWPKEIWSHYADDLASFSKPENATAGVYCINHLVLNALGHVQHVLTYLASLREQSSFQFCAIPQVMAIATLALVFGNERVLQTSVKIRKGTTCYLILKSRTFQGCVEIFEHYLRDIRKRLTVADPNYLKLNIEIAKLDKFIEEMYQDKLPVGAKPQETEIYKKVRERSAYDLEVLPREQEEEFKFNVLLSILFTVFGALYWYAK

SEQ ID NO: 197 - protein, 443 aa, Cyberlindnera jadinii
MGKLLQLALHPDELASIVQFKLFRKNENARNPATESAELIRCYELLNLTSRSFAAVIEELHPELRNVIMVFYLVLRALDTVEVDMSIENSVKLPVLRQFHEKLDTKDWTFDGNSPNEKDRCVLVEFDRILGQYHELKPQYQKVIKEITEKMGNGMADYIENENFNSNGLLTIEDYDLYCYYVAGLVGDGLTQLIVLAKFGNSELSVNKQLFKSMGLFLQKTNIIRDYEEDQVDGRAFWPKEIWGKYANELSDFMKPENQSQGLWCISELVCNALDHVIDVLQYLALVEEQTSFNFCAIPQVMAIATLELVFQNPQVLTQHVKIRKGTTVSLILESRTLEGCARIFRRYLRKIHHKSHPSDPNYLRLGITIGKIEQFLDGMYPHYVPKGITPQTTSIRTQVVKRLQLDEPMKRDIDEEILKTRILLLSLGVAVFGVVYGVVRII

SEQ ID NO: 198 - protein, 448 aa, Candida albicans
MGKFLQLLSHPTELKAVIQLFGFRQPLHPGKRDVNDKELGRCYELLNLTSRSFAAVIEELHPELRDAVMIFYLVLRALDTIEDDMTIKSSIKIPLLREFDTKLNTKNWTFDGYGPNEKDRTVLVEFDKILNVYHRLKPQYQDIIKSITFKMGNGMADYILDEEFNVYGVATVEDYNLYCHYVAGLVGEGLTNLFVLANFGDKTLTENNFAKADSMGLFLQKTNIIRDYHEDLQDGRSFWPREIWSKYTENLQDFHKVKTPAKEFAGVSCINELVLNALGHVTDCLDYLSLVKDPSSFSFCAIPQVMAVATLAEVYNNPKVLHGVVKIRKGTTCRLILESRTLPGVVKIFKEYIQVINHKSSVRDPNYLKIGIKCGEIEQYCEMIYPNKQALPPSMKSLPENKFTKIVASRESIDLSVQRRIEPGNFNCNVVLFGIGALILSLIYFVLY

SEQ ID NO: 199 - protein, 731 aa, Saccharomyces cerevisiae
MTEFYSDTIGLPKTDPRLWRLRTDELGRESWEYLTPQQAANDPPSTFTQWLLQDPKFPQPHPERNKHSPDFSAFDACHNGASFFKLLQEPDSGIFPCQYKGPMFMTIGYVAVNYIAGIEIPEHERIELIRYIVNTAHPVDGGWGLHSVDKSTVFGTVLNYVILRLLGLPKDHPVCAKARSTLLRLGGAIGSPHWGKIWLSALNLYKWEGVNPAPPETWLLPYSLPMHPGRWWVHTRGVYIPVSYLSLVKFSCPMTPLLEELRNEIYTKPFDKINFSKNRNTVCGVDLYYPHSTTLNIANSLVVFYEKYLRNRFIYSLSKKKVYDLIKTELQNTDSLCIAPVNQAFCALVTLIEEGVDSEAFQRLQYRFKDALFHGPQGMTIMGTNGVQTWDCAFAIQYFFVAGLAERPEFYNTIVSAYKFLCHAQFDTECVPGSYRDKRKGAWGFSTKTQGYTVADCTAEAIKAIIMVKNSPVFSEVHHMISSERLFEGIDVLLNLQNIGSFEYGSFATYEKIKAPLAMETLNPAEVFGNIMVEYPYVECTDSSVLGLTYFHKYFDYRKEEIRTRIRIAIEFIKKSQLPDGSWYGSWGICFTYAGMFALEALHTVGETYENSSTVRKGCDFLVSKQMKDGGWGESMKSSELHSYVDSEKSLVVQTAWALIALLFAEYPNKEVIDRGIDLLKNRQEESGEWKFESVEGVFNHSCAIEYPSYRFLFPIKALGMYSRAYETHTL

SEQ ID NO: 200 - protein, 417 aa, Homo sapiens
MEFVKCLGHPEEFYNLVRFRIGGKRKVMPKMDQDSLSSSLKTCYKYLNQTSRSFAAVIQALDGEMRNAVCIFYLVLRALDTLEDDMTISVEKKVPLLHNFHSFLYQPDWRFMESKEKDRQVLEDFPTISLEFRNLAEKYQTVIADICRRMGIGMAEFLDKHVTSEQEWDKYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 201 - protein, 416 aa, Mus musculus
MEFVKCLGHPEEFYNLLRFRMGGRRNFIPKMDQDSLSSSLKTCYKYLNQTSRSFAAVIQALDGDIRHAICVFYLVLRALDTVEDDMSISVEKKIPLLCNFHTFLYDPEWRFTESKEKDRQVLEDFPTISLEFRNLAEKYQTVIDDICHRMGCGMAEFVDKDVTSKQDWDKYCHYVAGLVGIGLSRLFSASEFEDPIVGEDIECANSMGLFLQKTNIIRDYLEDQQEGRKFWPQEVWGRYIKKLEDFAKPENVDVAVQCLNELITNTLQHIPDVLTYLSRLRNQSVFNFCAIPQVMAIATLAACYNNQQVFKGVVKIRKGQAVTLMMDATNMPAVKAIIYQYIEEIYHRIPNSDPSSSKTKQVISKIRTQNLPNCQLISRSHYSPIYLSFIMLLAALSWQYLSTLSQVTEDYVQREH

SEQ ID NO: 202 - protein, 416 aa, Rattus norvegicus
MEFVKCLGHPEEFYNLLRFRMGGRRNFIPKMDRNSLSNSLKTCYKYLDQTSRSFAAVIQALDGDIRHAVCVFYLILRAMDTVEDDMAISVEKKIPLLRNFHTFLYEPEWRFTESKEKHRVVLEDFPTISLEFRNLAEKYQTVIADICHRMGCGMAEFLNKDVTSKQDWDKYCHYVAGLVGIGLSRLFSASEFEDPIVGEDTECANSMGLFLQKTNIIRDYLEDQQEGRQFWPQEVWGKYVKKLEDFVKPENVDVAVKCLNELITNALQHIPDVITYLSRLRNQSVFNFCAIPQVMAIATLAACYNNHQVFKGVVKIRKGQAVTLMMDATNMPAVKAIIYQYIEEIYHRVPNSDPSASKAKQLISNIRTQSLPNCQLISRSHYSPIYLSFIMLLAALSWQYLSTLSQVTEDYVQREH

SEQ ID NO: 203 - protein, 396 aa, Aspergilus nidulans
MTSDSHFHPPHAIPPRISSNRMSGASTRDKAALMGNFEKDWLSKGDKLQTNTDLSKRHTRNQSSLDGTKYKDGKWSQENEEVIMGPYDYMLQHPGKDLRRQMINAFNVWLKVPSESLAIITKVVAMLHTASLLIDDVEDNSLLRRGIPVAHSIYGTAQTINSANYVYFLALQEVQKLKSPAAIDIYVQELLNLHRGQGMDLFWRDTLTCPSEDEYLEMVGNKTGGLFRLAVKLMQAESSTGKDCVALVNVLGLVFQICDDYLNLSDTTYTQNKGLCEDLTEGKFSFPIIHSIRSNPGNHQLINILRQRTKDEEVKRYALQYMESTGSFKHTQDVVRQLRARALQLIEEIENSENGEQPEEHNDGTMVRAILDKITESTLADTNTTTRDINGNCATR

SEQ ID NO: 204 - protein, 485 aa, Stevia rebaudiana; identical to SEQ ID NO: 14

SEQ ID NO: 205 - DNA, 1673 bp, Stevia rebaudiana
gctggccaaatgtacaacgttacttatcatcaaaattcaaaagcaatggctaccagtgactccatagttgacgaccgtaagcagcttcatgttgcgacgttcccatggcttgctttcggtcacatcctccctttccttcagctttcgaaattgatagctgaaaagggtcacaaagtctcgtttctttctaccaccagaaacattcaacgtctctcttctcatatctcgccactcataaatgttgttcaactcacacttccacgtgtccaagagctgccggaggatgcagaggcgaccactgacgtccaccctgaagatattcaatatctcaagaaggctgttgatggtcttcaaccggaggtcacccggtttctagaacaacactctccggactggattatttatgattttactcactactggttgccatccatcgcggctagcctcggtatctcacgagcctacttctgcgtcatcactccatggaccattgcttatttggcaccctcatctgacgccatgataaatgattcagatggtcgaaccacggttgaggatctcacgacaccgcccaagtggtttccctttccgaccaaagtatgctggcggaagcatgatcttgcccgaatggagccttacgaagctccggggatatctgatggataccgtatggggatggtttttaagggatctgattgtttgcttttcaaatgttaccatgagtttggaactcaatggctacctcttttggagacactacaccaagtaccggtggttccggtgggattactgccgccggaaatacccggagacgagaaagatgaaacatgggtgtcaatcaagaaatggctcgatggtaaacaaaaaggcagtgtggtgtacgttgcattaggaagcgaggctttggtgagccaaaccgaggttgttgagttagcattgggtctcgagctttctgggttgccatttgtttgggcttatagaaaaccaaaaggtcccgcgaagtcagactcggtggagttgccagacgggttcgtggaacgaactcgtgaccgtgggttggtctggacgagttgggcacctcagttacgaatactgagccacgagtcagtttgtggtttcttgactcattgtggttctggatcaattgtggaagggctaatgtttggtcaccctctaatcatgctaccgattttttgtgaccaacctctgaatgctcgattactggaggacaaacaggtgggaatcgagataccaagaaatgaggaagatggttgcttgaccaaggagtcggttgctagatcactgaggtccgttgttgtggaaaacgaaggggagatctacaaggcgaacgcgagggcgctgagtaaaatctataacgacactaaggtggaaaaagaatatgtaagccaattcgtagactatttggaaaagaatgcgcgtgcggttgccatcgatcatgagagttaactatatcatcaagtatgtgtgagttgttgggtttcttttggaaagattcaaatgaaatgttggaattgctaaatatgttggtagaatcgatcgagtcttaggaggtgtcctagttaattgttttaagctactatattaataagttgttattgtaaggctatttaaagccaaattatgtgatgaataaagcaattgattccagccgt

The invention claimed is:

1. A recombinant host cell, comprising:

(a) a gene encoding a polypeptide capable of beta 1,2 glycosylation of the C2' of the 13-O-glucose, 19-O-glucose, or both 13-O-glucose and 19-O-glucose of a steviol glycoside and having at least 90% sequence identity to the amino acid sequence set forth in SEQ ID NO:152;

(b) a gene encoding a steviol synthase polypeptide (KAH) having at least 90% sequence identity to the amino acid sequence set forth in SEQ ID NOs:142-146 or 90% sequence identity to the amino acid sequence set forth in SEQ ID NO:164;

(c) a gene encoding an ent-copalyl diphosphate synthase (CDPS) polypeptide least 90% sequence identity to the amino acid sequence set forth in SEQ ID NOs:129-131, 158 or 160;

(d) a gene encoding a cytochrome P450 reductase (CPR) polypeptide having at least 90% sequence identity to the amino acid sequence set forth in SEQ ID NOs:168 or 170;

(e) one or more genes encoding an kaurene oxidase (KO) polypeptide having at least 90% sequence identity to the amino acid sequence set forth in SEQ ID NOs:138-141;

(f) a gene encoding a kaurene synthase (KS) polypeptide having at least 90% sequence identity to the amino acid sequence set forth in SEQ ID NOs:132-135 or 156; and (g) a gene encoding a geranylgeranyl diphosphate synthase (GGPPS) having at least 90% identity to the amino acid sequence set forth in SEQ ID NOs:121-128;

wherein the recombinant host cell further comprises one or more of:

(h) a gene encoding a Uridine-5'-diphospho (UDP) dependent glucosyltransferase (UGT) polypeptide capable of glycosylation of the 13-OH of steviol or a steviol glycoside and having at least 90% sequence identity to the amino acid sequence set forth in SEQ ID NO:3;

(i) a gene encoding a UGT polypeptide capable of beta 1,3 glycosylation of the C3' of the 13-O-glucose, 19-O-glucose, or both 13-O-glucose and 19-O-glucose of a steviol glycoside and having at least 90% sequence identity to the amino acid sequence set forth in SEQ ID NO:7;

(j) a gene encoding a UGT polypeptide capable of glycosylation of the C-19 carboxyl of steviol or a steviol glycoside and having at least 90% sequence identity to the amino acid sequence set forth in SEQ ID NO:1; or (k) a gene encoding a UGT polypeptide capable of beta 1,2 glycosylation of the C2' of the 13-O-glucose, 19-O-glucose, or both 13-O-glucose and 19-O-glucose of a steviol glycoside and having at least 90% sequence identity to the amino acid sequence set forth in SEQ ID NO:5;

wherein at least one of the genes is a recombinant gene; and wherein the recombinant host cell is capable of producing one or more steviol glycosides.

2. The recombinant host cell of claim 1, wherein the recombinant host cell further comprises one or more of:

a gene encoding a bifunctional CDPS and KS;

(ii) one or more genes encoding a sucrose transporter (SUC1) polypeptide having at least 90% identity to the amino acid sequence set forth in SEQ ID NO: 179 and a sucrose synthase (SUS1) polypeptide having at least 90% sequence identity to the amino acid sequence set forth in SEQ ID NO: 180 or at least 90% sequence identity to the amino acid sequence encoded by the nucleotide sequence set forth in SEQ ID NOs:175-177;

(iii) a nucleic acid sequence, comprising a heterologous insert sequence operably linked to an open reading frame encoding a squalene synthase (SQS) polypeptide having at least 90% sequence identity to the amino acid sequence set forth in SEQ ID NOs:192-198 or 200-202;

(iv) a gene encoding a truncated 3-hydroxy-3-methyl-glutaryl (HMG)-CoA (HMG-CoA) polypeptide;

(v) a gene encoding a rhamnose synthetase polypeptide;

(vi) a gene encoding a UDP-glucose dehydrogenase polypeptide; or (vii) a gene encoding a UDP-glucuronic acid decarboxylase polypeptide, wherein at least one of these genes is a recombinant gene.

3. The recombinant host cell of claim 2, wherein the expression of the one or more recombinant genes encoding the SUC1 polypeptide and expression of the SUS1 polypeptide results in increased levels of uridine diphosphate glucose (UDP-glucose) in the host cell.

4. The recombinant host cell of claim 1, wherein the recombinant host cell is a fungal cell, a bacterial cell or a plant cell.

5. The recombinant host cell of claim 4, wherein the fungal cell comprises a yeast cell.

6. The recombinant host cell of claim 5, wherein the yeast cell is a cell from *Saccharomyces cerevisiae, Schizosaccharomyces pombe, Yarrowia lipolytica, Candida glabrata, Ashbya gossypii, Cyberlindnera jadinii, Pichia pastoris, Kluyveromyces lactis, Hansenula polymorpha, Candida boidinii, Arxula adeninivorans, Xanthophyllomyces dendrorhous*, or *Candida albicans* species.

7. The recombinant host cell of claim 6, wherein the yeast cell is a Saccharomycete.

8. The recombinant host cell of claim 7, wherein the yeast cell is a *Saccharomyces cerevisiae* cell.

9. The recombinant host cell of claim 4, wherein the bacterial cell is from *Escherichia coli* species or *Bacillus* genus.

10. The recombinant host cell of claim 1, wherein the one or more steviol glycosides comprises steviol-13-O-glucoside, steviol-1,2-bioside, steviol-1,3-bioside, steviol-19-O-glucoside, stevioside, 1,3 stevioside, rubusoside, rebaudioside A, rebaudioside B, rebaudioside C, rebaudioside D, rebaudioside E, rebaudioside F, or dulcoside A.

11. The recombinant host cell of claim 1, wherein the host cell is capable of producing rebaudioside D upon transfer of a glucose moiety to rebaudioside A.

12. The recombinant host cell of claim 1, wherein the UGT polypeptide capable of beta 1,2 glycosylation of the C2' of the 13-O-glucose, 19-O-glucose, or both 13-O-glucose and 19-O-glucose of the steviol glycoside comprises a polypeptide having a substitution at residues 211 and 286 of SEQ ID NO:5.

13. The recombinant host cell of claim 1, wherein the UGT polypeptide capable of beta 1,2 glycosylation of the C2' of the 13-O-glucose, 19-O-glucose, or both 13-O-glucose and 19-O-glucose of the steviol glycoside comprises a polypeptide having a methionine at residue 211 and an alanine at residue 286 of SEQ ID NO:5.

14. The recombinant host cell of claim 1, wherein the CDPS polypeptide is lacking a chloroplast transit peptide.

15. A cell culture medium comprising:

(a) the recombinant host cell of claim 1; and (b) one or more steviol glycosides produced by the recombinant host cell;

wherein at least one of the one or more steviol glycosides is present at a concentration of at least 1 mg/liter of the culture medium.

16. A cell culture medium comprising:

(a) the recombinant host cell of claim 1; and (b) one or more steviol glycosides produced by the recombinant host cell;

wherein at least one of the one or more steviol glycosides is present at a concentration of at least 1 mg/liter of the culture medium;

wherein the culture medium further comprises glucose, UDP-glucose, UDP-rhamnose, UDP-xylose, N-acetyl-glucosamine, and/or YNB.

17. A cell culture medium comprising:

(a) the recombinant host cell of claim 1; and (b) one or more steviol glycosides produced by the recombinant host cell;

wherein at least one of the one or more steviol glycosides is present at a concentration of at least 1 mg/liter of the culture medium;

wherein the culture medium further comprises glucose, UDP-glucose, UDP-rhamnose, UDP-xylose, N-acetyl-glucosamine, and/or YNB;

wherein the culture medium has a reduced level of non-steviol glycoside *Stevia* plant-derived components relative to a plant-derived *stevia* extract.

18. A cell culture medium comprising:

(a) the recombinant host cell of claim 1; and (b) one or more steviol glycosides produced by the recombinant host cell;

wherein at least one of the one or more steviol glycosides is present at a concentration of at least 1 mg/liter of the culture medium;

wherein the culture medium further comprises glucose, UDP-glucose, UDP-rhamnose, UDP-xylose, N-acetyl-glucosamine, and/or YNB;

wherein the culture medium is enriched for the rebaudioside D relative to a steviol glycoside extract of *Stevia* plant and has a reduced level of non-steviol glycoside *Stevia* plant-derived components relative to a plant-derived *stevia* extract.

19. A method of producing a steviol glycoside, comprising growing the recombinant host cell of claim 1 in a culture medium, under conditions in which one or more of the genes are expressed; wherein the one or more steviol glycosides is produced by the recombinant host cell.

20. The method of claim 19, wherein the one or more steviol glycosides is produced in a permeabilized recombinant host cell which has been transformed with the gene encoding the polypeptide capable of beta 1,2 glycosylation of the C2' of the 13-O-glucose, 19-O-glucose, or both 13-O-glucose and 19-O-glucose of the steviol glycoside and having at least 90% sequence identity to the amino acid sequence set forth in SEQ ID NO:152.

21. The method of claim 20, wherein the one or more steviol glycosides is rebaudioside D, wherein rebaudioside D is produced upon transfer of a glucose moiety to rebaudioside A.

22. The method of claim 20, wherein the permeabilized recombinant host cell comprises *Escherichia coli.*

23. The method of claim 19, wherein one or more of the genes is constitutively expressed and/or expression of one or more of the genes is induced.

24. The method of claim 19, wherein the recombinant host cell is grown in a fermentor at a temperature for a period of time, wherein the temperature and period of time facilitate the production of the steviol glycoside.

25. The method of claim 19, that further comprises recovering the one or more steviol glycosides alone or a composition comprising the one or more steviol glycosides.

26. The method of claim 25, wherein the recovered composition is enriched for the one or more steviol glycosides, relative to a steviol glycoside composition from a *Stevia* plant.

27. The method of claim 25, wherein the recovered composition has a reduced level of non-steviol glycoside *Stevia* plant-derived components relative to a plant-derived *stevia* extract.

28. The method of claim 19, wherein the one or more steviol glycosides comprises steviol-13-O-glucoside, steviol-1,2-bioside, steviol-1,3-bioside, steviol-19-O-glucoside, stevioside, 1,3 stevioside, rubusoside, rebaudioside A, rebaudioside B, rebaudioside C, rebaudioside D, rebaudioside E, rebaudioside F, or dulcoside A.

29. The method of claim 19, wherein the recombinant host cell is a fungal cell, a bacterial cell or a plant cell.

30. The method of claim 29, wherein the fungal cell comprises a yeast cell.

31. The method of claim 29, wherein the yeast cell is a cell from *Saccharomyces cerevisiae, Schizosaccharomyces pombe, Yarrowia lipolytica, Candida glabrata, Ashbya gossypii, Cyberlindnera jadinii, Pichia pastoris, Kluyveromyces lactis, Hansenula polymorpha, Candida boidinii, Arxula adeninivorans, Xanthophyllomyces dendrorhous*, or *Candida albicans* species.

32. The method of claim 31, wherein the yeast cell is a Saccharomycete.

33. The method of claim 32, wherein the yeast cell is a *Saccharomyces cerevisiae* cell.

34. The method of claim 29, wherein the bacterial cell is from *Escherichia coli* species or *Bacillus* genus.

* * * * *